United States Patent
Burns et al.

(10) Patent No.: US 9,657,329 B2
(45) Date of Patent: May 23, 2017

(54) PROPEPTIDE-LUCIFERASE FUSION PROTEINS AND METHODS OF USE THEREOF

(71) Applicants: THE BROAD INSTITUTE, INC., Cambridge, MA (US); The General Hospital Corporation, Boston, MA (US); INSTITUTO CARLOS SLIM DE LA SALUD, A.C., Granada, Mexico City (MX)

(72) Inventors: Sean Burns, Hingham, MA (US); David Altshuler, Brookline, MA (US); Amedeo Vetere, Cambridge, MA (US)

(73) Assignees: The Broad Institute Inc., Cambridge, MA (US); The General Hospital Corporation, Boston, MA (US); Instituto Carlos slim de la Salud, A.C., Mexico City (MX)

( * ) Notice: Subject to any disclaimer, the term of this patent is extended or adjusted under 35 U.S.C. 154(b) by 0 days.

(21) Appl. No.: 14/356,864

(22) PCT Filed: Nov. 7, 2012

(86) PCT No.: PCT/US2012/063982
§ 371 (c)(1),
(2) Date: May 7, 2014

(87) PCT Pub. No.: WO2013/070796
PCT Pub. Date: May 16, 2013

(65) Prior Publication Data
US 2014/0303035 A1    Oct. 9, 2014

Related U.S. Application Data

(60) Provisional application No. 61/556,619, filed on Nov. 7, 2011, provisional application No. 61/576,530, filed on Dec. 16, 2011.

(51) Int. Cl.
*C40B 30/06* (2006.01)
*C12Q 1/66* (2006.01)
(Continued)

(52) U.S. Cl.
CPC .............. *C12Q 1/66* (2013.01); *C07K 14/575* (2013.01); *C07K 14/605* (2013.01); *C07K 14/62* (2013.01);
(Continued)

(58) Field of Classification Search
CPC .... C12Q 1/66; C12Q 1/6897; C12N 9/00069; C07K 14/605; C07K 14/62;
(Continued)

(56) References Cited

U.S. PATENT DOCUMENTS 9,181,318 B2 * 11/2015 Satoshi ................. C07K 14/62
2011/0159529 A1    6/2011 Inouye et al.
2013/0243741 A1 *  9/2013 Bossmann .......... C08B 37/0015
                                                    424/93.21

FOREIGN PATENT DOCUMENTS

GB      2 468 757 A      9/2010

OTHER PUBLICATIONS

Liu et al., Proinsulin maturation, misfolding, and proteotoxicity, PNAS, Oct. 2, 2007, vol. 104, No. 40, 15841-15846.*
(Continued)

*Primary Examiner* — Reza Ghafoorian
(74) *Attorney, Agent, or Firm* — Vedder Price P.C.; Thomas J. Kowalski; Deborah L. Lu

(57) ABSTRACT

The present invention provides nucleic acid constructs that encode fusion peptides comprising a bioluminescent protein and a precursor of a secreted peptide or protein expressed at the cell surface and high throughput screening assays using same.

31 Claims, 14 Drawing Sheets

(51) Int. Cl.
- *C12Q 1/68* (2006.01)
- *G01N 33/50* (2006.01)
- *C07K 14/575* (2006.01)
- *C07K 14/605* (2006.01)
- *C07K 14/62* (2006.01)
- *C12N 9/02* (2006.01)
- *G01N 33/58* (2006.01)

(52) U.S. Cl.
CPC ......... *C12N 9/0069* (2013.01); *C12Q 1/6897* (2013.01); *G01N 33/5008* (2013.01); *G01N 33/5035* (2013.01); *G01N 33/5073* (2013.01); *G01N 33/581* (2013.01); *C07K 2319/00* (2013.01); *C07K 2319/50* (2013.01); *C07K 2319/60* (2013.01)

(58) Field of Classification Search
CPC ............ C07K 2319/00; C07K 2319/50; C07K 2319/60; G01N 33/5008; G01N 33/5035; G01N 33/5073; G01N 33/581
See application file for complete search history.

(56) References Cited

OTHER PUBLICATIONS

Promega, pTARGET Mammalian Expression Vector System, published and revised in Feb. 2006, Promega Corporation.*

Promega, Dual-Luciferase® Reporter 1000 Assay System, published and revised in Mar. 2009, Promega Corporation.*

Pouli et al., "Insulin targeting to the regulated secretory pathway after fusion with green fluorescent protein and firefly luciferase", *Biochemical Journal*, 331(2):669-675 (1998).

Suzuki, T. et al., "Video rate bioluminescence imaging of secretory proteins in living cells: Localization, secretory frequency and quantification", *Analytical Biochemistry*, Academic Press Inc., NY, 415(2):182-189 (2011).

Watkins, S. et al., "Imaging Secretory Vesicles by Fluorescent Protein Insertion in Propeptide Rather Than Mature Secreted Peptide", *Traffic*, 3(7):461-471 (2002).

* cited by examiner

PROPEPTIDE-LUCIFERASE FUSION PROTEINS AND METHODS OF USE THEREOF

RELATED APPLICATION

This application is a U.S. National Phase application of International application No. PCT/US2012/063982 filed on Nov. 7, 2012, which claims the benefit of, priority to U.S. provisional application No. 61/556,619 filed on Nov. 7, 2011 and U.S. provisional application No. 61/576,530 filed on Dec. 16, 2011, the contents of each of which are incorporated herein by references in its entireties.

INCORPORATION-BY-REFERENCE OF SEQUENCE LISTING

The contents of the text file named "BRDI-016_N01US_ST25.txt", which was created on Oct. 3, 2014 and is 717 KB in size, are hereby incorporated by reference in their entireties.

FIELD OF THE INVENTION

The present invention provides methods and compositions relating to detecting peptide secretion or cell surface expression of a peptide by a cell.

BACKGROUND OF THE INVENTION

Peptide hormones, cytokines and neuropeptides are signaling molecules that play key roles in normal physiology and disease states. Traditional immunoassays for these secreted proteins, such as the enzyme-linked immunosorbent assay (ELISA) and radioimmunoassay, have enabled limited investigation into the pathways regulating their secretion, yet these assays are too expensive and time-consuming to be useful for large-scale chemical and genetic screening. Thus, a need exists for a high-throughput method of tracking peptide secretion or cell surface expression of a peptide.

A particular secreted peptide of interest is insulin. Failure to maintain adequate insulin secretion is central to the pathogenesis of both type 1 and type 2 diabetes. Determining the genetic pathways that regulate insulin secretion and finding small molecule probes of these pathways would greatly advance our understanding of the beta cell and bring us closer to a cure for both forms of diabetes. However, high throughput screens of insulin secretion using genetic (e.g., RNAi) or chemical perturbations are currently impracticable due to the lack of an amenable assay for measuring secreted insulin. Insulin ELISA kits and radioimmunoassays are not well suited to this application due to their expense, complicated handling requirements and restriction to 96-well format. Thus, a need exists for a high-throughput method of tracking peptide secretion, in particular, insulin hormone secretion.

SUMMARY OF THE INVENTION

The invention is based upon the discovery of methods and compositions relating to detecting peptide secretion from a cell or peptide expression at the cell surface, including but not limited to peptide hormones, cytokines and neuropeptides.

In one aspect the invention provides a nucleic acid construct encoding a fusion protein comprising a peptide hormone or peptide precursor linked to a bioluminescent protein, wherein the bioluminescent protein is flanked by two cleavage sites such that wherein the fusion protein is expressed by a cell the bioluminescent protein is cleaved from the peptide precursor and the bioluminescent protein is secreted simultaneously with the secretion or cell surface expression of the mature form of the propeptide. The propeptide is a prohormone, a preprohormone, a cytokine precursor or a neuropeptide precursor.

Exemplary propeptides that can be used in the present invention include, but are not limited to, the precursor proteins of amylin, insulin, glucagon (includes GRPP, glucagon, GLP-1, GLP-2), peptide YY, neuropeptide Y, pancreatic polypeptide, somatostatin, growth hormone-releasing hormone (GHRH), proopiomelanocortin (POMC, including ACTH, MSH), oxytocin, vasopressin-neurophysin-2, gonadotropin-releasing hormone (GnRH), thyroid-stimulating hormone, beta subunit (TSHB), cortisol-releasing factor (CRF), atrial natriuretic peptide (ANP), brain natriuretic peptide (BNP), renin, galanin, orexin, ghrelin-obestatin, cholecystokinin, gastrin, protachykinin-1 (substance P, neurokinin A, neuropeptide K, neuropeptide gamma), proenkephalin-A, proenkephalin-B, insulin-like growth hormone 1 (IGF-1), insulin-like growth hormone 2 (IGF-2), parathyroid hormone (PTH), parathyroid hormone-related protein (PTHrP), osteocalcin, urocortin-3, urocortin-2, urocortin-1, fibroblast growth factor 23 (FGF23), interleukin-1-beta (IL1B), tumor necrosis factor (TNF), interferon-gamma (IFNG), sortilin (SORT1), neuropeptide W, cocaine and amphetamine-related transcript (CART), transforming growth factor-beta-1 (TGFB1), transforming growth factor-beta-2 (TGFB2), transforming growth factor-beta-3 (TGFB3), platelet-derived growth factor-alpha (PDGFA), brain-derived neurotrophic factor (BDNF), nerve growth factor (NGF), albumin, calcitonin, cortistatin (CORT), ADAM-10, -11, -12, -15, -17, -22, -23, -28, -33, ADAMTS-1, -3-10, -12 through -20, BMP-1 through -6, -10, MMP-11, -14 through -17, -21, -23, -24, -25, -28, beta-defensins and mesothelin.

Preferably, the peptide precursor is encoded by any one of the nucleotide sequences of SEQ ID NOs: 5-100. Optionally the nucleic acid construct contains a promoter.

In some embodiments the peptide precursor is preproinsulin and the bioluminescent protein is within the C-peptide component of preproinsulin. In other embodiments, the peptide precursor is preproamylin and the N-terminal end of the bioluminescent protein is inserted between the regions encoding the signal peptide and the mature amylin hormone or between the mature amylin hormone and the C-terminus of the molecule. In another embodiment, the peptide precursor is preproglucagon and the bioluminescent protein is inserted between the regions encoding the GRPP and glucagon, glucagon and GLP-1, or GLP-1 and GLP-2. The nucleic acid construct further comprises an additional cleavage site at the N-terminal and C-terminal ends of the bioluminescent protein. Optionally, there is an additional cleavage site at the C-terminal end of the bioluminescent protein. Optionally, there are at least 3 additional nucleotides flanking at least one cleavage site to enhance cleavage.

Exemplary cleavage sites that can be used for the constructs of the present invention include, but are not limited to, aagagg (SEQ ID NO: 101); aagcgt (SEQ ID NO: 102); aagcgc (SEQ ID NO: 103); aaaaga (SEQ ID NO: 104); aagaggagg (SEQ ID NO: 105); aagaga (SEQ ID NO: 106); cgcaaa (SEQ ID NO: 107); cggcgg (SEQ ID NO: 108); tatctg (SEQ ID NO: 109); aggcgg (SEQ ID NO: 110); cggagc (SEQ ID NO: 111); cggtct (SEQ ID NO: 112);

cgaagc (SEQ ID NO: 113); aaacgg (SEQ ID NO: 114); aagagaggt (SEQ ID NO: 115); aaacgaggc (SEQ ID NO: 116); gggccgccgc (SEQ ID NO: 117); ccacgagct (SEQ ID NO: 118); ccccgagct (SEQ ID NO: 119); cgaaggcagct-gcgggct (SEQ ID NO: 120); cgtaggcagctgagggta (SEQ ID NO: 121); cgccgcagt (SEQ ID NO: 122); cgaaga (SEQ ID NO: 123); cggaga (SEQ ID NO: 124); agaagg (SEQ ID NO: 125); aaacgc (SEQ ID NO: 126); tccagcattcggagg (SEQ ID NO: 127); agcagtcggagg (SEQ ID NO: 128); gagagggac (SEQ ID NO: 129); cggcgc (SEQ ID NO: 130); aggcgc (SEQ ID NO: 131); cggggcaccaag (SEQ ID NO: 132); caccgc (SEQ ID NO: 133); acccgtgtc (SEQ ID NO: 134); tcgcgcatt (SEQ ID NO: 135); cgacgg (SEQ ID NO: 136); aagagaaga (SEQ ID NO: 137); and ggccgccgc (SEQ ID NO: 138).

The bioluminescent protein is luciferase, such as for example, *Gaussia* luciferase or *Cypridina* luciferase. In some embodiments, the bioluminescent protein is truncated, for example, the *Gaussia* or the *Cypridina* luciferase lacks a native signal sequence. The invention also includes a cell comprising a nucleic acid construct of the invention and a fusion protein encoded by the nucleic acid construct of the invention. The cell is capable of expressing the encoded fusion protein. The cell is, for example, a pancreatic cell, an immune cell, a neuron, a hepatocyte, a myocyte, a kidney cell, an adipocyte, an osteocyte or a cell line derived therefrom. The cell is for example, a peptide-secreting cell such as a beta cell, an alpha cell, an L-cell, a K-cell, a neuron or a cell line derived therefrom. The cell is for example, an immune cell such as a B cell, a T cell, a monocyte, a macrophage, a dendritic cell, a mast cell, a neutrophil or a cell line derived therefrom. Alternatively, the cell is an embryonic stem cell or an iPS cell. The invention also includes a cell comprising at least two nucleic acid constructs of the invention, wherein the cell is capable of expressing the encoded fusion proteins and wherein the bioluminescent proteins of the nucleic acid constructs are different. For example, the first nucleic acid construct comprises *Gaussia* luciferase and the second nucleic acid construct comprises *Cypridina* luciferase. Optionally, the cell also comprises a control nucleic acid construct encoding a control luciferase different from the luciferase of the fusion proteins to be used as an internal reference.

The invention further provides an assay for screening for compounds that modulate peptide secretion or cell surface expression of a peptide by a cell by contacting the cell culture comprising the cell of the invention with a test compound and determining bioluminescence in the cell culture. A difference in bioluminescence from the cell culture that has been contacted with the test compound compared to bioluminescence from a control cell culture indicates that the test compound modulates peptide secretion or expression at the cell surface.

The invention further provides an assay for screening for compounds that modulate peptide secretion or cell surface expression of the peptide bu a cell by contacting the cell culture comprising the cell of the invention with a test compound, separating the population of cells into single cells, and determining bioluminescence in the cell culture. A difference in bioluminescence from the cell culture that has been contacted with the test compound compared to bioluminescence from a control cell culture indicates that the test compound modulates peptide secretion or cell surface expression. The separation of the population of cells into single cells can be performed by, for example, a microfluidic device. In some embodiments, the test compound is a test nucleic acid and further comprising determining the identity of the test nucleic acid using single cell nucleic acid amplification methods.

The invention also provides a method of screening for compounds that differentiate embryonic stem cells or induced pluripotent stem (iPS) cells into mature cell types of interest, such as pancreatic beta cells, by contacting a cell culture comprising the cells of the invention with a test compound and determining bioluminescence in the cell culture. An increase in bioluminescence from the cell culture that has been contacted with the test compound compared to bioluminescence from a control cell culture indicates that the test compound induced differentiation of embryonic stem cells or iPS cells into the cell type of interest.

The invention also provides a method of screening for compounds that differentiate embryonic stem cells or iPS cells into glucose responsive beta cells by contacting a cell culture comprising the cells of the invention with a test compound and determining bioluminescence in the cell culture. An increase of bioluminescence from the cell culture that has been contacted with the test compound compared to bioluminescence from a control cell culture indicates that the test compound differentiates embryonic stem cells or iPS cells into glucose responsive beta cells.

The test compound is for example a nucleic acid or a small molecule. The nucleic acid is for example an RNAi or gene overexpression sequence.

The present invention also provides a nucleic acid expression vector comprising a nucleic acid sequence encoding a bioluminescent protein, wherein the bioluminescent protein lacks a native signal peptide; a nucleic acid sequence encoding two cleavage sites, wherein the cleavage sites flank the bioluminescent protein such that when the vector is expressed by a cell, the bioluminescent protein is cleaved from the remaining peptide; and at least one insertion site for insertion of a nucleic acid sequence encoding a propeptide such that the inserted nucleic acid sequence is in-frame with the bioluminescent protein. The insertion site is a restriction enzyme site, multiple cloning site containing multiple restriction enzyme sites, or a site recognized by a recombinase. Optionally, the nucleic acid expression vector comprises a promoter, wherein the promoter is operatively linked to the nucleic acid sequence encoding the bioluminescent protein. Optionally, the nucleic acid expression vector comprises a selective marker operatively linked to a second promoter. The selective marker can be an antibiotic resistance gene, drug resistance gene, toxin resistance gene or a cell surface marker.

Alternatively, a nucleic acid expression vector may comprise any nucleic acid construct described herein operatively linked to a promoter and a selective marker operatively linked to a second promoter.

The present invention further provides a kit. The kit includes any or at least one of the nucleic acid expression vectors described herein, at least one luciferase substrate and instructions for use. The luciferase substrate will be selected according to the nucleic acid expression vector of the kit, such that the luciferase of the expression vector will dictate the luciferase substrate included in the kit. The present invention further provides a kit that contains any one of the cells that express a propeptide-luciferase fusion protein as described herein. Any kit of the present invention further comprises a control nucleic acid construct that encodes a control luciferase or cells expressing the control luciferase for use as an internal control.

Unless otherwise defined, all technical and scientific terms used herein have the same meaning as commonly understood by one of ordinary skill in the art to which this invention pertains. Although methods and materials similar or equivalent to those described herein can be used in the practice of the present invention, suitable methods and materials are described below. All publications, patent applications, patents, and other references mentioned herein are expressly incorporated by reference in their entirety. In cases of conflict, the present specification, including definitions, will control. In addition, the materials, methods, and examples described herein are illustrative only and are not intended to be limiting.

Other features and advantages of the invention will be apparent from and encompassed by the following detailed description and claims.

DETAILED DESCRIPTION OF THE INVENTION

Figure 1A:
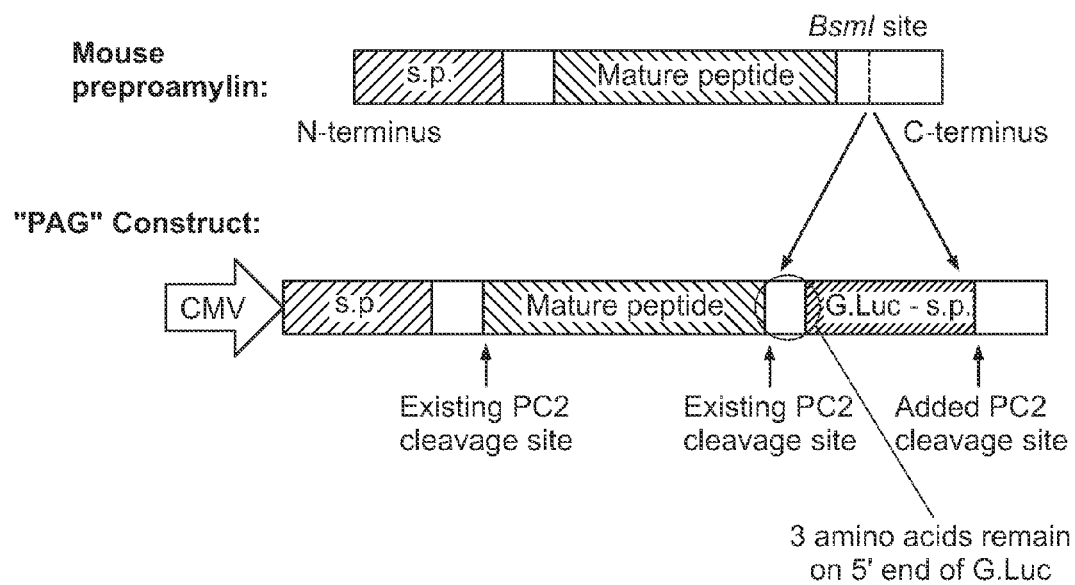
FIG. 1 depicts the structure of the preproamylin-*Gaussia* luciferase (PAG) construct and its expression in MIN6 cells. (A) The luciferase was placed near the C-terminal end of the proamylin peptide, adjacent to an existing "prohormone convertase 2" (PC2) cleavage site. An additional PC2 cleavage site was inserted to the 3'-end of the luciferase sequence. s.p. stands for signal peptide. (B) Immunohistochemistry of MIN6 cells expressing preproamylin-luciferase reporter showing co-localization of luciferase and insulin.

The invention is based in part upon methods and compositions relating to detecting peptide secretion or cell surface expression of the peptide by a cell, including but not limited to that of peptide hormones, cytokines, neuropeptides and transmembrane proteins. Examples of such peptides include but are not limited to, insulin, amylin, glucagon, glucagon-like peptide-1 (GLP-1), glucagon-like peptide-2 (GLP-2), gastric inhibitory peptide (GIP), growth hormone (GH), proopiomelanocortin (POMC)-derived hormones, growth hormone releasing hormone (GHRH), parathyroid hormone (PTH), gonadotropin releasing hormone (GnRH), peptide YY, neuropeptide Y, protachykinin-1 (Substance P, Neurokinin A, Neuropeptide K, Neuropeptide gamma), proenkephalin-A, proenkephalin-B, oxytocin, vasopressin-neurophysin-2, thyroid-stimulating hormone, beta subunit (TSHB), cortisol-releasing factor (CRF), atrial natriuretic peptide (ANP), brain natriuretic peptide (BNP), renin, galanin, orexin, ghrelin-obestatin, cholecystokinin, gastrin, insulin-like growth hormone 1 (IGF-1), insulin-like growth hormone 2 (IGF-2), parathyroid hormone (PTH), parathyroid hormone-related protein (PTHrP), osteocalcin, urocortin-3, urocortin-2, urocortin-1, fibroblast growth factor 23 (FGF23), interleukin-1-beta (IL1B), tumor necrosis factor (TNF), interferon-gamma (IFNG), sortilin (SORT1), neuropeptide W, cocaine and amphetamine-related transcript (CART), transforming growth factor-beta-1 (TGFB1), transforming growth factor-beta-2 (TGFB2), transforming growth factor-beta-3 (TGFB3), platelet-derived growth factor-alpha (PDGFA), brain-derived neurotrophic factor (BDNF), nerve growth factor (NGF), albumin, calcitonin, cortistatin (CORT), ADAM-10, -11, -12, -15, -17, -22, -23, -28, -33, ADAMTS-1, -3-10, -12 through -20, BMP-1 through -6, -10, MMP-11, -14 through -17, -21, -23, -24, -25, -28, beta-defensins and mesothelin. The methods are useful in screening for compounds or genes that modulate peptide secretion or cell surface expression. Specifically, the invention provides for the high throughput measurement of peptide secretion or cell surface expression in the setting of genetic and chemical perturbations, and as such is well suited to screens for genes and compounds impacting physiologic processes. Additionally, the methods are useful in screening for compounds that are capable of differentiating one cell type (e.g., embryonic stem cells or iPS cells) into mature cell type, such as a peptide-secreting cell type (e.g., glucose-responsive pancreatic beta cell).

The present invention provides novel tools and methods for measuring peptide secretion or expression at the cell surface. In some embodiments, the peptide is a hormone peptide, prohormone, or precursor thereof. In some embodiments, the peptide is a neuropeptide or precursor thereof. In other embodiments, the peptide is a cytokine or precursor thereof. Specifically, the present invention provides a fusion protein comprising a propeptide and a bioluminescent protein, nucleic acid constructs encoding the fusion proteins, vectors and host cells containing the nucleic acid constructs. The fusion gene constructs may also contain promoters and other transcriptional and/or translational regulatory sequences to drive expression of the fusion gene.

Propeptide Fusion Protein Constructs

Fusion proteins comprise a single continuous linear polymer of amino acids which comprise the full or partial sequence of two or more distinct proteins. The construction of fusion proteins is well-known in the art. Two or more amino acids sequences may be joined chemically, for instance, through the intermediacy of a crosslinking agent. In a preferred embodiment, a fusion protein is generated by expression of a fusion gene construct in a cell. A fusion gene construct comprises a single continuous linear polymer of nucleotides which encodes the full or partial sequences of two or more distinct proteins. Fusion gene constructs of the present invention contain a reporter gene in addition to other genes or fragments thereof that encode at least one propeptide. Fusion gene constructs generally also contain replication origins active in eukaryotic and/or prokaryotic cells and one or more selectable markers encoding, for example, drug resistance. They may also contain viral packaging signals as well as transcriptional and/or translational regulatory sequences and RNA processing signals.

Reporter genes for use in the invention encode detectable proteins, include, but are by no means limited to, Luciferase, Thalassicolin, Aequorin, Mitrocomin, Clytin (synonomous with Phialidin, Obelin, Mnemiopsin) and Berovin. For example, the detectable protein is a bioluminescent protein. An exemplary bioluminescent protein is the *Gaussia* luciferase, which is utilized for its unique properties of being small in size and with increased luminescence in comparison to other more commonly used luciferases (1000 times brighter than Firefly or *Renilla* luciferase). Another exemplary bioluminescent protein is the *Cypridina* luciferase. In some embodiments, the bioluminescent protein is truncated or a fragment thereof such that the bioluminescent protein retains its luminescent characteristics. The bioluminescent protein may have a native signal peptide that controls its secretion. Preferably, the bioluminescent protein lacks the native signal peptide. An exemplary modified luciferase is the *Gaussia* luciferase wherein the luciferase lacks the N-terminal signal peptide that controls the secretion of the luciferase (e.g., SEQ ID NO: 1). An exemplary modified luciferase is the *Cypridina* luciferase wherein the luciferase lacks the N-terminal signal peptide (e.g., SEQ ID NO: 3).

The configuration of the propeptide fusion proteins of the present invention is unique. Early studies and attempts for hormone-reporter fusion proteins have had limited success. Early hormone-reporter constructs caused varying levels of toxicity to the host cells. Other constructs were improperly processed, for example the fusion proteins were sequestered in the endoplasmic reticulum or other secretory pathway organelles rather than appropriately secreted. Other prohormone reporters were constructed such that the mature hormone was fused to the reporter protein, which could potentially result in misfolding and retention of the fusion proteins, as well as alteration of the function and activity of the mature hormone. As described above, these early hormone-reporter fusion proteins had limitations in their use for accurately tracking hormone secretion and amenability for high throughput screening assays. The fusion proteins of the present invention were specifically designed to address the difficulties and limitations of the previous generation of hormone-receptor fusion proteins.

Three modifications were made to an early preproinsulin fusion protein to reduce toxicity to host cells and increase accuracy of secretion for peptide tracking. (1) The bioluminescent protein utilized is small, comprised of less than 200 amino acids. For example, the bioluminescent protein is a *Gaussia* luciferase. The *Gaussia* luciferase is additionally modified such that it is lacking its native secretion signal peptide. (2) The prohormone gene of the fusion protein and the host cell are of the same species. The early preproinsulin fusion protein utilized a human preproinsulin gene and was expressed in a mouse cell line. It would be well within the knowledge of the skilled artisan to use the present disclosure to construct propeptide fusion proteins for expression in mouse, rat, or hamster pancreatic cell lines (i.e., beta-cell lines) with mouse, rat or hamster prohormone genes, which are known in the art. Similarly, the skilled artisan would be able to construct a human prohormone fusion protein using the present disclosure for expression in a human pancreatic cell line (i.e., beta-cell line) upon availability of said cell line. (3) Cleavage sites were introduced into the fusion protein such that there is minimal intervening sequence between the cleavage site and the bioluminescent protein that may interfere with proper processing. For example, for the proinsulin-luciferase fusion construct, no extra amino acids are present between the cleavage site and the bioluminescent protein, such that the luciferase will have no extra amino acids after it is cleaved out of proinsulin. Together, these modifications produced prohormone fusion proteins useful for tracking peptide hormone secretion, as described herein.

An important distinction between the fusion proteins of the present invention and other hormone reporter proteins is that the fusion protein of the present invention is processed normally to produce a mature hormone peptide that is fully intact, unmodified, does not contain additional amino acids, and therefore, should be fully functional. Furthermore, the mature hormone peptide is predicted to be fully competent for endogenous interactions, signaling, and function. The bioluminescent protein is processed and secreted simultaneously and in parallel to secretion of the mature hormone, thereby providing an accurate readout of secretion or expression at the cell surface of the mature hormone. In contrast, other hormone-reporter constructs irreversibly join the mature hormone with the bioluminescent or reporter protein, thereby significantly altering the processing, secretion and downstream function of both the mature hormone and the luciferase protein.

The inventors also discovered that this strategy is useful for other propeptides that are processed prior to secretion or cell surface expression. The nucleic acid constructs and fusion proteins described herein are useful for the tracking peptide secretion and expression at the cell surface.

The present invention provides fusion proteins that comprise a propeptide and a bioluminescent protein. The bioluminescent protein is inserted into the propeptide such that there is at least one cleavage site at the N-terminal end and at least one cleavage site at the C-terminal end of the bioluminescent protein. Any one of the cleavage sites can be native to the propeptide or can be introduced through recombinant DNA techniques known in the art. Exemplary cleavage sites for prohormone fusion proteins, include but are not limited to, prohormone convertase ⅓ (PC⅓), prohormone convertase 2 (PC2), and caspase-1 cleavage sites. Preferably, the cleavage sites are the same cleavages sites that are normally used to process the endogenous propeptide. Utilizing the same cleavage sites at the N and C-terminal ends of the bioluminescent protein that are normally used to process the propeptide allows the cleavage of the bioluminescent protein upon processing of the propeptide for secretion of the mature protein. Importantly, the cleaved bioluminescent protein is free (e.g., separated or non-covalently linked) from the mature peptide(s), and therefore, serves as an accurate readout of peptide secretion or expression of the peptide at the cell surface. In some embodiments, the cleavage sites can be selected and introduced by the skilled artisan such that the bioluminescent protein is cleaved only under specific circumstances determined by the skilled artisan (e.g., cellular context). For example, the skilled artisan could control fusion protein processing and bioluminescent protein secretion by introducing PC2 cleavage sites at the N and C-terminal ends of the bioluminescent protein and expressing the fusion protein in cells that only express PC2 at a certain time or under a specific condition.

The nucleic acid sequences listed in SEQ ID NO: 139 through SEQ ID NO: 330 encode fusion proteins in which a bioluminescent protein is incorporated into a propeptide, flanked by cleavage sites required for the maturation of the propeptide into a mature protein. Whereas the original propeptide cleavage site is maintained on the 5' end of the bioluminescent protein in each fusion protein, an additional cleavage site is added at the 3' end of the bioluminescent protein in each fusion protein to allow for release of the bioluminescent protein after proper cleavage. Both the native and added cleavage sites are underlined in the nucleic acid sequences. While most constructs were designed with the minimal required sequence (i.e., beginning of proprotein—cleavage site #1—bioluminescent protein—cleavage site #2—end of proprotein), in some cases extra flanking nucleotides were included around each cleavage site to create the optimal context for cleavage at these locations, as predicted by the available scientific literature on each protein.

These additional nucleotides encode additional amino acids that enhance cleavage at the cleavage site are referred to herein as "additional cleavage sequence" or ACS. Cleavage sites in which cleavage can be enhanced through additional amino acids can be readily determined by one of ordinary skill in the art through available scientific literature. Some cleavage sites do not require presence of an ACS. ACS can comprise 3 or more nucleotides, wherein the total number of nucleotides is a multiple of 3. For example, the ACS may be 3, 6, 9, 12, or more nucleotides. The ACS encodes amino acids that do not interfere with the function of the fusion protein. For example, the ACS encodes 1, 2, 3, 4, or more additional amino acids.

Optionally, restriction enzyme sites can be added on either side of the bioluminescent protein to allow for construction of the fusion protein. These restriction enzyme sites do not alter the function or expression of the bioluminescent protein and the propeptide.

The present invention provides a nucleic acid construct encoding a fusion protein comprising a peptide precursor linked to a bioluminescent protein, wherein the bioluminescent protein is flanked by two cleavage sites such that wherein the fusion protein is expressed by a cell the bioluminescent protein is cleaved from the peptide precursor and secreted simultaneously with the mature protein.

The present invention provides a nucleic acid construct encoding a fusion protein comprising a peptide precursor linked to a bioluminescent protein, wherein the bioluminescent protein is flanked by two cleavage sites such that wherein the fusion protein is expressed by a cell the bioluminescent protein is cleaved from the peptide precursor simultaneously upon expression of the mature peptide at the cell surface.

The present invention encompasses fusion proteins encoded by the nucleic acid constructs described herein. The fusion proteins have at least 70%, 75%, 80%, 85%, 90%, or 95% sequence identity to the fusion proteins encoded by the nucleic acid constructs of the present invention, such that the resulting fusion protein retains the ability to be cleaved to separate the bioluminescent protein and the mature peptide such that the bioluminescent protein is secreted and the mature form of the propeptide is either secreted or expressed on the cell surface. In some embodiments, the fusion proteins have at least 90%, 91%, 92%, 93%, 94%, 95%, 96%, 97%, 98%, or 99% sequence identity to the fusion proteins encoded by the nucleic acid constructs of the present invention, such that the resulting fusion protein retains the ability to be cleaved to separate the bioluminescent protein and the mature peptide such that the bioluminescent protein is secreted and the mature form of the propeptide is either secreted or expressed on the cell surface. Additionally, the mature peptide produced by the fusion protein having 70%, 75%, 80%, 85%, 90%, or 95% sequence identity to the fusion proteins encoded by the nucleic acid constructs of the present invention has activities substantially similar to the native (e.g., endogenous) mature peptide.

The present invention provides a preproinsulin fusion protein. Preproinsulin consists of a B-peptide, a C-peptide, and an A-peptide (from N to C-terminus). The bioluminescent protein is inserted within the C-peptide component of preproinsulin. A native PC⅓ cleavage sites exists between the B-peptide and the C-peptide, and a native PC2 cleavage site exists between the C-peptide and the A-peptide. In some embodiments, the bioluminescent protein replaces all or some portion of the C-peptide. In some embodiments, the bioluminescent protein is flanked at the N and C terminus by the native cleavage cites. Optionally, an additional cleavage site is added at the N or C-terminal end of the bioluminescent protein. In some embodiments, the bioluminescent protein two cleavage sites are added at the N and C terminus of the bioluminescent protein, i.e., PC2 cleavage sites.

The present invention provides a preproamylin fusion protein. Native PC2 cleavage sites exist at the N and C-terminal ends of the mature amylin peptide. The bioluminescent protein is located at the C-terminus of the preproamylin, adjacent to the native prohormone convertase enzyme 2 (PC2) cleavage site at the C-terminus of the mature amylin peptide. Optionally, an additional cleavage site is added at the C-terminal end of the bioluminescent protein, i.e. PC2. Optionally, an additional cleavage site is inserted at the N and C-terminal end of the bioluminescent protein. Optionally, restriction enzyme sites can be added on either side of the bioluminescent protein to allow for construction of the fusion protein (e.g., aatgca in SEQ ID NO: 139 and SEQ ID NO: 140). These restriction sites are dispensable for the function of the fusion protein.

The present invention provides a preproglucagon fusion protein. The preproglucagon comprises four distinct peptides GRPP, glucagon, GLP-1 (glucagon-like protein 1), and GLP-2 (glucagon-like protein 2), in order from N to C-terminus. Native PC2 sites exist between GRPP and glucagon, two PC2 sites exist between glucagon and Glp-1, a PC1 site exists between glucagon and Glp-1 (in between the existing PC2 sites), and a PC1 site exists between Glp-1 and Glp-2. The bioluminescent protein is inserted between the GLP-1 and GLP-2 encoding regions. Optionally, an additional cleavage site is added at the C-terminal end of the bioluminescent protein, i.e., PC2. In some embodiments, the cellular context in which the preproglucagon fusion protein is expressed determines which peptide is tracked by the bioluminescent protein. In one embodiment, the preproglucagon fusion protein is expressed in L cells which express PC1 and therefore would cause cleavage of the Glp-1 peptide and the bioluminescent protein such that the luminescence would accurately reflect Glp-1 secretion. In one embodiment, the preproglucagon fusion protein is expressed in alpha cells which express PC2 and therefore would cause cleavage of the glucagon peptide and the bioluminescent protein such that the luminescence would accurately reflect glucagon secretion.

Additionally, the present invention provides a fusion protein comprising one propeptide selected from the group consisting of: peptide YY, neuropeptide Y, pancreatic polypeptide, somatostatin, growth hormone-releasing hormone (GHRH), proopiomelanocortin (POMC, including ACTH, MSH), oxytocin, vasopressin-neurophysin-2, gonadotropin-releasing hormone (GnRH), thyroid-stimulating hormone, beta subunit (TSHB), cortisol-releasing factor (CRF), atrial natriuretic peptide (ANP), brain natriuretic peptide (BNP), renin, galanin, orexin, ghrelin-obestatin, cholecystokinin, gastrin, protachykinin-1 (substance P, neurokinin A, neuropeptide K, neuropeptide gamma), proenkephalin-A, proenkephalin-B, insulin-like growth hormone 1 (IGF-1), insulin-like growth hormone 2 (IGF-2), parathyroid hormone (PTH), parathyroid hormone-related protein (PTHrP), osteocalcin, urocortin-3, urocortin-2, urocortin-1, fibroblast growth factor 23 (FGF23), interleukin-1-beta (IL1B), tumor necrosis factor (TNF), interferon-gamma (IFNG), sortilin (SORT1), neuropeptide W, cocaine and amphetamine-related transcript (CART), transforming growth factor-beta-1 (TGFB1), transforming growth factor-beta-2 (TGFB2), transforming growth factor-beta-3 (TGFB3), platelet-derived growth factor-alpha (PDGFA), brain-derived neurotrophic factor (BDNF), nerve growth factor (NGF), albumin, calcitonin, cortistatin (CORT), ADAM-10, -11, -12, -15, -17, -22, -23, -28, -33, ADAMTS-1, -3-10, -12 through -20, BMP-1 through -6, -10, MMP-11, -14 through -17, -21, -23, -24, -25, -28, beta-defensins and mesothelin.

The fusion gene constructs of the invention are introduced into cells to assay for peptide secretion. The fusion gene constructs may also contain promoters and other transcriptional and/or translational regulatory sequences that are normally associated with the gene encoding propeptide. The fusion gene constructs may be introduced into cells by any method of nucleic acid transfer known in the art, including, but not limited to, viral vectors, transformation, co-precipitation, electroporation, neutral or cationic liposome-mediated transfer, microinjection or gene gun. Viral vectors include retroviruses, poxviruses, herpes viruses, adenoviruses, and adeno-associated viruses. Particularly preferred in the present invention are retroviral vectors, which are capable of stable integration into the genome of the host cell. For example, retroviral constructs encoding integration and packaging signals, drug resistance markers and one or more fusion genes of interest are useful in the practice of the invention.

The fusion gene constructs or fusion proteins of the invention may be introduced into cultured cells, animal cells in vivo, animal cells ex vivo, or any other type of cell in which it is desired to study peptide secretion. Preferably, the fusion gene construct is introduced into a cell in which the peptide is secreted or a precursor cell thereof. For example, the fusion gene construct comprising preproinsulin or preproamylin is introduced into beta cells to measure insulin secretion. In some embodiments the beta cell is a beta cell line, such as the murine MIN6 beta cell line or the rat INS-1E beta cell line. The beta cell may be a mouse, rat or hamster beta cell. To measure glucagon or GLP-1 secretion, the fusion construct comprising preproglucagon is introduced into alpha cells or L-cells, respectively. Although a human beta cell line is not yet available in the art, the skilled artisan would be able to use and apply the methods described herein to expressing the fusion proteins of the invention in such a human beta cell line upon its availability.

The recombinant cells of the invention that express the fusion constructs of the invention provide for development of screening assays, particularly for high throughput screening of molecules that up- or down-regulate the activity of peptide secretion.

Exemplary luciferase nucleic acid sequences include, but are not limited to:

*Gaussia luciferase* without signal peptide or stop codon (nucleic acid sequence):

(SEQ ID NO: 1)

Aagcccaccgagaacaacgaagacttcaacatcgtggccgtggccagcaacttcgcgaccacggatctcgatgctgaccgcgggaa gttgcccggcaagaagctgccgctggaggtgctcaaagagatggaagccaatgcccggaaagctggctgcaccaggggctgtctga tctgcctgtcccacatcaagtgcacgcccaagatgaagaagttcatcccaggacgctgccacacctacgaaggcgacaaagagtccg -continued cacagggcggcataggcgaggcgatcgtcgacattcctgagattcctgggttcaaggacttggagcccatggagcagttcatcgcaca ggtcgatctgtgtgtggactgcacaactggctgcctcaaaggggcttgccaacgtgcagtgttctgacctgctcaagaagtggctgccgc aacgctgtgcgacctttgccagcaagatccagggccaggtggacaagatcaaggggccggtggtgac

*Gaussia luciferase* with signal peptide and stop codon (nucleic acid sequence):
(SEQ ID NO: 2)

Atgggagtcaaagttctgtttgccctgatctgcatcgctgtggccgaggccaagcccaccgagaacaacgaagacttcaacatcgtgg ccgtggccagcaacttcgcgaccacggatctcgatgctgaccgcgggaagttgcccggcaagaagctgccgctggaggtgctcaaa gagatggaagccaatgcccggaaagctggctgcaccaggggctgtctgatctgcctgtcccacatcaagtgcacgcccaagatgaag aagttcatcccaggacgctgccacacctacgaaggcgacaaagagtccgcacagggcggcataggcgaggcgatcgtcgacattcc tgagattcctgggttcaaggacttggagcccatggagcagttcatcgcacaggtcgatctgtgtgtggactgcacaactggctgcctcaa agggcttgccaacgtgcagtgttctgacctgctcaagaagtggctgccgcaacgctgtgcgacctttgccagcaagatccagggccag gtggacaagatcaaggggccggtggtgactaa

*Cypridina luciferase* without signal peptide or stop codon (nucleic acid sequence):
(SEQ ID NO: 3)

Tactgcgccactgttcattgccaggactgtccttacgaacctgatccaccaaacacagttccaacttcctgtgaagctaaagaaggagaa tgtattgatagcagctgtggcacctgcacgagagacatactatcagatggactgtgtgaaaataaaccaggaaaaacatgttgccgaatg tgtcagtatgtaattgaatgcagagtagaggccgcaggatggtttagaacattctatggaaagagattccagttccaggaacctggtacat acgtgttgggtcaaggaaccaagggcggcgactggaaggtgtccatcaccctggagaacctggatggaaccaaggggctgtgctg accaagacaagactggaagtggctggagacatcattgacatcgctcaagctactgagaatcccatcactgtaaacggtggagctgacc ctatcatcgccaacccgtacaccatcggcgaggtcaccatcgctgctgttgagatgccaggcttcaacatcaccgtcattgagttcttcaa actgatcgtgatcgacatcctcggaggaagatctgtaagaatcgccccagacacagcaaacaaaggaatgatctctggcctctgtgga gatcttaaaatgatggaagatacagacttcacttcagatccagaacaactcgctattcagcctaagatcaaccaggagtttgacggttgtc cactctatggaaatcctgatgacgttgcatactgcaaaggtcttctggagccgtacaaggacagctgccgcaacccccatcaacttctacta ctacaccatctcctgcgccttcgcccgctgtatgggtggagacgagcgagcctcacgcgtgctgcttgactacagggagacgtgcgct gctcccgaaactagaggaacctgcgttttgtctggacatactttctacgatacatttgacaaagcaagataccaattccagggtccctgca aggagattcttatggccgccgactgtttctggaacacttgggatgtgaaggtttcacacaggaatgttgactcttacactgaagtagagaa agtacgaatcaggaaacaatcgactgtagtagaactcattgttgatggaaaacagattctggttggaggagaagccgtgtccgtcccgta cagctctcagaacacttccatctactggcaagatggtgacatactgactacagccatcctacctgaagctctggtggtcaagttcaacttc aagcaactgctcgtcgtacatattagagatccattcgatggtaagacttgcggtatttgcggtaactacaaccaggatttcagtgatgattct tttgatgctgaaggagcctgtgatctgaccccccaacccaccgggatgcaccgaagaacagaaacctgaagctgaacgactctgcaata gtctcttcgccggtcaaagtgatcttgatcagaaatgtaacgtgtgccacaagcctgaccgtgtcgaacgatgcatgtacgagtattgcct gaggggacaacagggtttctgtgaccacgcatgggagttcaagaaagaatgctacataaagcatggagacaccctagaagtaccaga tgaatgcaaa

*Cypridina luciferase* with signal peptide and stop codon (nucleic acid sequence):
(SEQ ID NO: 4)

atgaagaccttaattcttgccgttgcattagtctactgcgccactgttcattgccaggactgtccttacgaacctgatccaccaaacacagtt ccaacttcctgtgaagctaaagaaggagaatgtattgatagcagctgtggcacctgcacgagagacatactatcagatggactgtgtga aaataaaccaggaaaaacatgttgccgaatgtgtcagtatgtaattgaatgcagagtagaggccgcaggatggtttagaacattctatgg aaagagattccagttccaggaacctggtacatacgtgttgggtcaaggaaccaagggcggcgactggaaggtgtccatcaccctgga gaacctggatggaaccaaggggctgtgctgaccaagacaagactggaagtggctggagacatcattgacatcgctcaagctactga gaatcccatcactgtaaacggtggagctgaccctatcatcgccaacccgtacaccatcggcgaggtcaccatcgctgttgttgagatgc caggcttcaacatcaccgtcattgagttcttcaaactgatcgtgatcgacatcctcggaggaagatctgtaagaatcgccccagacacag caaacaaaggaatgatctctggcctctgtggagatcttaaaatgatggaagatacagacttcacttcagatccagaacaactcgctattca -continued gcctaagatcaaccaggagtttgacggttgtccactctatggaaatcctgatgacgttgcatactgcaaaggtcttctggagccgtacaag gacagctgccgcaaccccatcaacttctactactacaccatctcctgcgccttcgccgctgtatgggtggagacgagcgagcctcaca cgtgctgcttgactacagggagacgtgcgctgctcccgaaactagaggaacctgcgttttgtctggacatactttctacgatacatttgac aaagcaagataccaattccagggtccctgcaaggagattcttatggccgccgactgtttctggaacacttgggatgtgaaggtttcacac aggaatgttgactcttacactgaagtagagaaagtacgaatcaggaaacaatcgactgtagtagaactcattgttgatggaaaacagattc tggttggaggagaagccgtgtccgtcccgtacagctctcagaacacttccatctactggcaagatggtgacatactgactacagccatcc tacctgaagctctggtggtcaagttcaacttcaagcaactgctcgtcgtacatattagagatccattcgatggtaagacttgcggtatttgcg gtaactacaaccaggatttcagtgatgattcttttgatgctgaaggagcctgtgatctgaccccaacccaccgggatgcaccgaagaac agaaacctgaagctgaacgactctgcaatagtctcttcgccggtcaaagtgatcttgatcagaaatgtaacgtgtgccacaagcctgacc gtgtcgaacgatgcatgtacgagtattgcctgaggggacaacagggtttctgtgaccacgcatgggagttcaagaaagaatgctacata aagcatggagacaccctagaagtaccagatgaatgcaaatag Exemplary nucleic acid sequences of the propeptides of the present invention include, but are not limited to, those listed below.

Proamylin Mouse (nucleic acid sequence):
(SEQ ID NO: 5)
atgatgtgcatctccaaactgccagctgtcctcctcatcctctctgtggcactgaaccacttgagagctacacctgtcagaagtggtagca accctcagatggacaaacggaagtgcaacacggccacgtgtgccacacaacgcctggcaaacttttttggttcgttccagcaacaaccttt ggtccagtcctcccaccaaccaacgtgggatcgaatacatatggcaagaggaatgcggcaggggatccaaatagggaatccaggatt tcttactcgtttaa Proamylin Human (nucleic acid sequence):
(SEQ ID NO: 6)
atgggcatcctgaagctgcaagtatttctcattgtgctctctgttgcattgaaccatctgaaagctacacccattgaaagtcatcaggtggaa aagcggaaatgcaacactgccacatgtgcaacgcagcgcctggcaaattttttagttcattccagcaacaactttggtgccattctctcatc taccaacgtgggatccaatacatatggcaagaggaatgcagtagaggtttaaagagagagccactgaattacttgccccttag Proinsulin 2 Mouse (nucleic acid sequence):
(SEQ ID NO: 7)
atggccctgtggatgcgcttcctgcccctgctggccctgctcttcctctggggagtcccaccccacccaggcttttgtcaagcagcacctt gtggttcccacctggtggaggctctctacctggtgtgtggggagcgtggcttcttctacacacccatgtcccgccgtgaagtggaggac ccacaagtggcacaactggagctgggtggaggcccgggagcaggtgaccttcttgaccttggcactggaggtggcccagcagaagc gtggcattgtagatcagtgctgcaccagcatctgctccctctaccagctggagaactactgcaactag Proinsulin Human (nucleic acid sequence):
(SEQ ID NO: 8)
atggccctgtggatgcgcctcctgcccctgctggcgctgctggccctctggggacctgacccagccgcagcctttgtgaaccaacacct gtgcggctcacacctggtggaagctctctacctagtgtgcggggaacgaggcttcttctacacacccaagacccgccgggaggcaga ggacctgcaggtggggcaggtggagctgggcgggggccctggtgcaggcagcctgcagcccttggccctggaggggtccctgca gaagcgtggcattgtggaacaatgctgtaccagcatctgctccctctaccagctggagaactactgcaactag Proglucagon (includes GRPP, glucagon, GLP-1, GLP-2) Mouse (nucleic acid sequence):
(SEQ ID NO: 9)
atgaagaccatttactttgtggctggattgcttataatgctggtgcaaggcagctggcagcacgcccttcaagacacagaggagaaccc cagatcattcccagcttcccagacagaagcgcatgaggaccctgatgagatgaatgaagacaaacgccactcacagggcacattcac cagcgactacagcaaatacctggactcccgccgtgcccaagattttgtgcagtggttgatgaacaccaagaggaaccggaacaacatt gccaaacgtcatgatgaatttgagaggcatgctgaagggacctttaccagtgatgtgagttcttacttggagggccaggcagcaaagga attcattgcttggctggtgaaaggccgaggaaggcgagacttcccagaagaagtcgccattgccgaggaactcggccgcaggcacgc -continued tgatggctccttctctgacgagatgagcaccattctggataatcttgccaccagggacttcatcaactggctgattcaaaccaagatcactg acaagaaatag Proglucagon (includes GRPP, glucagon, GLP-1, GLP-2) Human (nucleic acid sequence):

(SEQ ID NO: 10)

atgaaaagcatttactttgtggctggattattgtaatgctggtacaaggcagctggcaacgttcccttcaagacacagaggagaaatcca gatcattctcagcttcccaggcagacccactcagtgatcctgatcagatgaacgaggacaagcgccattcacagggcacattcaccagt gactacagcaagtatctggactccaggcgtgcccaagattttgtgcagtggttgatgaataccaagaggaacaggaataacattgccaa acgtcacgatgaatttgagagacatgctgaagggacctttaccagtgatgtaagttcttatttggaaggccaagctgccaaggaattcatt gcttggctggtgaaaggccgaggaaggcgagatttcccagaagaggtcgccattgttgaagaacttggccgcagacatgctgatggtt cttttctctgatgagatgaacaccattcttgataatcttgccgccagggactttataaactggttgattcagaccaaaatcactgacaggaaat aa Peptide YY Mouse (nucleic acid sequence):

(SEQ ID NO: 11)

atggtggcggtgcgcaggccttggcccgtcacggtcgcaatgctgctaatcctgctcgcctgtctgggagccctggtggacgcctacc ctgccaaaccagaggctcccggcgaagacgcctccccggaggagctgagccgctactacgcctccctgcgccactacctcaacctg gtcacccggcagcggtatggaaaaagagatgtccccgcagctctgttctccaaactgctcttcacagacgacagcgacagcgagaac ctccccttcaggccagaaggtttggaccagtggtga Peptide YY Human (nucleic acid sequence)

(SEQ ID NO: 12)

atggtgttcgtgcgcaggccgtggcccgccttgaccacagtgcttctggccctgctcgtctgcctaggggcgctggtcgacgcctaccc catcaaacccgaggctcccggcgaagacgcctcgccggaggagctgaaccgctactacgcctccctgcgccactacctcaacctggt caccggcagcggtatgggaaaagagacggcccggacacgcttctttccaaaacgttcttccccgacggcgaggaccgccccgtca ggtcgcggtcggagggcccagacctgtggtga Neuropeptide Y Mouse (nucleic acid sequence)

(SEQ ID NO: 13)

atgctaggtaacaagcgaatggggctgtgtggactgaccctcgctctatctctgctcgtgtgtttgggcattctggctgaggggtaccccct ccaagccggacaatccgggcgaggacgcgccagcagaggacatggccagatactactccgctctgcgacactacatcaatctcatca ccagacagagatatggcaagagatccagccctgagacactgatttcagacctcttaatgaaggaaagcacagaaaacgcccccagaa caaggcttgaagacccttccatgtggtga Neuropeptide Y Human (nucleic acid sequence):

(SEQ ID NO: 14)

atgctaggtaacaagcgactggggctgtccggactgaccctcgccctgtccctgctcgtgtgcctgggtgcgctggccgaggcgtacc cctccaagccggacaacccgggcgaggacgcaccagcggaggacatggccagatactactcggcgctgcgacactacatcaacct catcaccaggcagagatatggaaaacgatccagcccagagacactgatttcagacctcttgatgagagaaagcacagaaaatgttccc agaactcggcttgaagaccctgcaatgtggtga Pancreatic polypeptide Mouse (nucleic acid sequence):

(SEQ ID NO: 15)

atggccgtcgcatactgctgcctctccctgtttctcgtatccacttgggtggctctgctgctgcagcccctgcaggggacctggggagcc cccctggagccaatgtacccaggcgactatgcgacacctgagcagatggcacaatatgaaactcagctccgcagatacatcaacacac tgaccaggcctaggtatgggaagagagccgaggaggagaacacaggtggacttcctggagtgcagctctcccccctgcaccagcccc ccagttggcttgattccctgctctgcgccctggagctga Pancreatic polypeptide Human (nucleic acid sequence):

(SEQ ID NO: 16)

atggctgccgcacgcctctgcctctccctgctgctcctgtccacctgcgtggctctgttactacagccactgctgggtgcccagggagcc ccactggagccagtgtacccaggggacaatgccacaccagagcagatggcccagtatgcagctgatctccgtagatacatcaacatg ctgaccaggcctaggtatgggaaaagacacaaagaggacacgctggccttctcggagtgggggtccccgcatgctgctgtccccagg gagctcagcccgctggacttataa -continued Somatostatin Mouse (nucleic acid sequence):
(SEQ ID NO: 17)
atgctgtcctgccgtctccagtgcgccctggctgcgctctgcatcgtcctggctttgggcggtgtcaccggcgcgccctcggaccccag actccgtcagtttctgcagaagtctctggcggctgccaccgggaaacaggaactggccaagtacttcttggcagagctgctgtccgagc ccaaccagacagagaatgatgccctggagcccgaggatttgccccaggcagctgagcaggacgagatgaggcttggagctgcagag gtctgccaactcgaacccagcaatggcaccccgggaacgcaaagctggctgcaagaacttcttctggaagacattcacatcctgttag Somatostatin Human (nucleic acid sequence):
(SEQ ID NO: 18)
atgctgtcctgccgcctccagtgcgcgctggctgcgctgtccatcgtcctggccctgggctgtgtcaccggcgctccctcggaccccag actcgtcagtttctgcagaagtccctggctgctgccgcggggaagcaggaactggccaagtacttcttggcagagctgctgtctgaac ccaaccagacggagaatgatgccctggaacctgaagatctgtcccaggctgctgagcaggatgaaatgaggcttgagctgcagagat ctgctaactcaaacccggctatggcaccccgagaacgcaaagctggctgcaagaatttcttctggaagactttcacatcctgttag GHRH Mouse (nucleic acid sequence):
(SEQ ID NO: 19)
atgctgctctgggtgctctttgtgatcctcatcctcaccagtggctcccactgctcactgccccctcacctcccttcaggatgcagcgaca cgtagatgccatcttcaccaccaactacaggaaactcctgagccagctgtatgcccggaaagtgatccaggacatcatgaacaagcaa ggggagaggatccaggaacaaagggccaggctcagccgccaggaagacagcatgtggacagaggacaagcagatgaccctgga gagcatcttgcagggattcccaaggatgaagccttcagcggacgcttga GHRH Human (nucleic acid sequence):
(SEQ ID NO: 20)
atgccactctgggtgttcttctttgtgatcctcaccctcagcaacagctcccactgctcccacctccccctttgaccctcaggatgcggcg gtatgcagatgccatcttcaccaacagctaccggaaggtgctgggccagctgtccgcccgcaagctgctccaggacatcatgagcag gcagcagggagagagcaaccaagagcgaggagcaaggggcacggcttggtcgtcaggtagacagcatgtgggcagaacaaaagca aatggaattggagagcatcctggtggccctgctgcagaagcacaggaactcccagggatga POMC (ACTH, MSH) Mouse (nucleic acid sequence):
(SEQ ID NO: 21)
atgccgagattctgctacagtcgctcaggggccctgttgctggccctcctgcttcagacctccatagatgtgtggagctggtgcctggag agcagccagtgccaggacctcaccacggagagcaacctgctggcttgcatccgggcttgcaaactcgacctctcgctggagacgccc gtgtttcctggcaacggagatgaacagccccctgactgaaaaccccggaagtacgtcatgggtcacttccgctgggaccgcttcggcc ccaggaacagcagcagtgctggcagcgcggcgcagaggcgtgcggaggaagaggcggtgtggggagatggcagtccagagccg agtccacgcgagggcaagcgctcctactccatggagcacttccgctggggcaagccggtgggcaagaaacggcgcccggtgaagg tgtaccccaacgttgctgagaacgagtcggcggaggccttcccctagagttcaagagggagctggaaggcgagcggccattaggctt ggagcaggtcctggagtccgacgcggagaaggacgacgggccctaccgggtggagcacttccgctggagcaacccgcccaagga caagcgttacggtggcttcatgacctccgagaagagccagacgcccctggtgacgctcttcaagaacgccatcatcaagaacgcgca caagaagggccagtga POMC (ACTH, MSH) Human (nucleic acid sequence):
(SEQ ID NO: 22)
atgccgagatcgtgctgcagccgctcggggggccctgttgctggccttgctgcttcaggcctccatggaagtgcgtggctggtgcctgga gagcagccagtgtcaggacctcaccacgaaagcaacctgctggagtgcatccgggcctgcaagcccgacctctcggccgagactc ccatgttcccgggaaatggcgacgagcagcctctgaccgagaaccccggaagtacgtcatgggccacttccgctgggaccgattcg gccgccgcaacagcagcagcagcggcagcagcggcgcagggcagaagcgcgaggacgtctcagcgggcgaagactgcggccc gctgcctgagggcggccccgagcccgcagcgatggtgccaagccgggcccgcgcgagggcaagcgctcctactccatggagca cttccgctggggcaagccggtgggcaagaagcggcgcccagtgaaggtgtaccctaacggcgccgaggacgagtcggccgaggc cttccccctggagttcaagagggagctgactggccagcgactccgggaggagatggcccgacggccctgccgatgacggcgca gggccaggccgacctggagcacagcctgctggtggcggccgagaagaaggacgagggcccctacaggatggagcacttccgc tggggcagcccgcccaaggacaagcgctacggcgggtttcatgacctccgagaagagccagacgcccctggtgacgctgttcaaaaa cgccatcatcaagaacgcctacaagaagggcgagtga Oxytocin Mouse (nucleic acid sequence):
(SEQ ID NO: 23)
atggcctgccccagtctcgcttgctgcctgcttggcttactggctctgacctcggcctgctacatccagaactgcccctgggcggcaag agggctgtgctggacctggatatgcgcaagtgtctcccctgcggcccgggcggcaaaggacgctgcttcggaccaagcatctgctgc gcggacgagctgggctgcttcgtgggcaccgccgaggcgctgcgctgccaggaggagaactacctgccttcgccctgccagtctgg ccagaagccctgcgggagcggaggccgctgcgccgccacaggcatctgctgcagcccggatggctgccgcacagaccccgcctg cgaccctgagtctgccttctcggagcgctga Oxytocin Human (nucleic acid sequence):
(SEQ ID NO: 24)
atggccggccccagcctcgcttgctgtctgctcggcctcctggcgctgacctccgcctgctacatccagaactgcccctgggaggca agagggccgcgccggacctcgacgtgcgcaagtgcctccctgcggccccggggcaaaggccgctgcttcgggcccaatatctg ctgcgcggaagagctgggctgcttcgtgggcaccgccgaagcgctgcgctgccaggaggagaactacctgccgtcgccctgccagt ccggccagaaggcgtgcgggagcggggccgctgcgcggtcttgggcctctgctgcagcccggacggctgccacgccgaccctg cctgcgacgcggaagccaccttctcccagcgctga Vasopressin-Neurophysin-2 Mouse (nucleic acid sequence):
(SEQ ID NO: 25)
atgctcgccaggatgctcaacactacgctctccgcttgtttcctgagcctgctggccttctcctccgcctgctacttccagaactgcccaag aggcggcaagagggccatctctgacatggagctgagacagtgtctccctgcggcccgggcggcaaaggacgctgcttcggaccaa gcatctgctgcgcggacgagctgggctgcttcgtgggcaccgccgaggcgctgcgctgccaggaggagaactacctgccctcgccc tgccagtccggccagaagccctgcgggagcggggccgctgcgccgccgtgggcatctgctgcagcgacgagagctgcgtggcc gagcccgagtgccacgacggtttttttccgcctcaccgcgctcgggagccaagcaacgccacacagctggacggccctgctcgggc gctgctgctaaggctggtacagctggctgggacacgggagtccgtggattctgccaagcccgggtctactga Vasopressin-Neurophysin-2 Human (nucleic acid sequence):
(SEQ ID NO: 26)
atgcctgacaccatgctgcccgcctgcttcctcggcctactggccttctcctccgcgtgctacttccagaactgcccgaggggcggcaa gagggccatgtccgacctggagctgagacagtgcctcccctgcggccccggggcaaaggccgctgcttcgggcccagcatctgct gcgcggacgagctgggctgcttcgtgggcacggctgaggcgctgcgctgccaggaggagaactacctgccgtcgccctgccagtcc ggccagaaggcgtgcgggagcggggccgctgcgccgccttcggcgtttgctgcaacgacgagagctgcgtgaccgagcccgagt gccgcgagggcttccaccgccgcgcccgccagcgaccggagcaacgccacgcagctggacgggccggccggggccttgctgc tgcggctggtgcagctggccggggcgcccgagcccttcgagcccgcccagcccgacgcctactga Gonadotropin-releasing hormone (GnRH) Mouse (nucleic acid sequence):
(SEQ ID NO: 27)
atgatcctcaaactgatggccggcattctactgctgactgtgtgtttggaaggctgctccagccagcactggtcctatggttgcgccctg ggggaaagagaaacactgaacacttggttgagtctttccaagagatgggcaaggaggtggatcaaatggcagaaccccagcacttcg aatgtactgtccactggccccgttcacccctcagggatctgcgaggagctctggaaagtctgattgaagaggaagccaggcagaagaa gatgtag Gonadotropin-releasing hormone (GnRH) Human (nucleic acid sequence):
(SEQ ID NO: 28)
atgaagccaattcaaaaactcctagctggcctattctactgactggtgcgtggaaggctgctccagccagcactggtcctatggactgc gccctggaggaaagagagatgccgaaaatttgattgattctttccaagagatagtcaaagaggttggtcaactggcagaaacccaacgc ttcgaatgcaccacgcaccagccacgttctcccctccgagacctgaaaggagctctggaaagtctgattgaagaggaaactgggcaga agaagatttaa Thyroid-stimulating hormone, beta subunit (TSHB) Mouse (nucleic acid sequence):
(SEQ ID NO: 29)
atgagtgctgccgtcctcctctccgtgcttttttgctcttgcttgtgggcaagcagcatccttttgtattcccactgagtatacaatgtacgtgga taggagagagtgtgcctactgcctgaccatcaacaccaccatctgtgctgggtattgtatgacacgggatatcaatggcaaactgtttcttc ccaaatatgcactctctcaggatgtctgtacatacagagacttcatctacagaacggtggaaataccaggatgcccgcaccatgttactcc -continued ttatttctccttccctgtcgccataagctgcaagtgtggcaagtgtaatactgacaacagtgactgcatacacgaggctgtcagaaccaact actgcaccaagccgcagtctttctatctgggggattttctgtttaa Thyroid-stimulating hormone, beta subunit (TSHB) Human (nucleic acid sequence):
(SEQ ID NO: 30)
atgactgctctctttctgatgtccatgcttttggccttacatgtgggcaagcgatgtcttttgtattccaactgagtatacaatgcacatcgaa aggagagagtgtgcttattgcctaaccatcaacaccaccatctgtgctggatattgtatgacacgggatatcaatggcaaactgtttcttcc caaatatgctctgtcccaggatgtttgcacatatagagacttcatctacaggactgtagaaataccaggatgcccactccatgttgctccct attttttcctatcctgttgctttaagctgtaagtgtggcaagtgcaatactgactatagtgactgcatacatgaagccatcaagacaaactactg taccaaacctcagaagtcttatctggtaggattttctgtctaa Cortisol-releasing factor (CRF) Mouse (nucleic acid sequence):
(SEQ ID NO: 31)
atgcggctgcggctgctggtgtccgcgggcatgctgctggtggctctgtcgtcctgcctgccttgcagggccctgctcagcaggggatc cgtcccccgagcgccgggccccgcagcccttgaatttcttgcagccggagcagccccagcaacctcagccggttctgatccgcat gggtgaagaatacttcctccgcctggggaatctcaacagaagtcccgctgctcggctgtccccaactccacgcccctcaccgcgggt cgcggcagccgcccctcgcacgaccaggctgcggctaacttttttccgcgtgttgctgcagcagctgcagatgcctcagcgctcgctcg acagccgcgcggagccggccgaacgcggcgccgaggatgccctcggtggccaccaggggcgctggagagggagaaggcggtc ggaggagccgcccatctctctggatctcaccttccaccttctgcgggaagtcttggaaatggcccgggcagagcagttagctcagcaa gctcacagcaacaggaaactgatggagattatcgggaaatga Cortisol-releasing factor (CRF) Human (nucleic acid sequence):
(SEQ ID NO: 32)
atgcggctgccgctgcttgtgtccgcgggagtcctgctggtggctctcctgccctgcccgccatgcagggcgctcctgagccgcgggc cggtcccgggagctcggcaggcgccgcagcaccctcagcccttggatttcttccagccgccgccgcagtccgagcagccccagcag ccgcaggctcggccggtcctgctccgcatgggagaggagtacttcctccgcctggggaacctcaacaagagcccggccgctcccctt cgcccgcctcctcgctcctcgccggaggcagcggcagccgcccttcgccgaacaggcgaccgccaactttttccgcgtgttgctgc agcagctgctgctgcctcggcgctcgctcgacagccccgcgggctctcgcggagcgcggcgctaggaatgccctcggcggccacca ggaggcaccggagagagaaaggcggtccgaggagcctcccatctcccctggatctcaccttccacctcctccgggaagtcttggaaat ggccagggccgagcagttagcacagcaagctcacagcaacaggaaactcatggagattattgggaaataa Atrial natriuretic peptide (ANP) Mouse (nucleic acid sequence):
(SEQ ID NO: 33)
atgggctccttctccatcaccctgggcttcttcctcgtcttggccttttggcttccaggccatattggagcaaatcctgtgtacagtgcggtgt ccaacacagatctgatggatttcaagaacctgctagaccacctggaggagaagatgccggtagaagatgaggtcatgcccccgcagg ccctgagtgagcagactgaggaagcaggggccgcacttagctcccteeccgaggtgcctccctggactggggaggtcaacccacct ctgagagacggcagtgctctagggcgcagcccctgggacccctccgatagatctgccctcttgaaaagcaaactgagggctctgctcg ctggcccctcggagcctacgaagatccagctgcttcgggggtaggattgacaggattggagcccagagtggactaggctgcaacagctt ccggtaccgaagataa Atrial natriuretic peptide (ANP) Human (nucleic acid sequence):
(SEQ ID NO: 34)
atgagctccttctccaccaccaccgtgagcttcctcctttttactggcattccagctcctaggtcagaccagagctaatcccatgtacaatgc cgtgtccaacgcagacctgatggatttcaagaatttgctggaccatttggaagaaaagatgcctttagaagatgaggtcgtgcccccaca agtgctcagtgagccgaatgaagaagcggggctgctctcagccccctcctgaggtgcctccctggaccggggaagtcagcccag cccagagagatggaggtgccctcgggcggggcccctgggactcctctgatcgatctgcccctcctaaaaagcaagctgagggcgctgc tcactgcccctcggagcctgcggagatccagctgcttcggggggcaggatggacaggattggagcccagagcggactgggctgtaac agcttccggtactga Brain natriuretic peptide (BNP) Mouse (nucleic acid sequence):
(SEQ ID NO: 35)
atggatctcctgaaggtgctgtcccagatgattctgtttctgcttttcctttatctgtcaccgctgggaggtcactcctatcctctgggaagtcc tagccagtctccagagcaattcaagatgcagaagctgctggagctgataagagaaaagtcggaggaaatggcccagagacagctctt -continued gaaggaccaaggcctcacaaaagaacacccaaaaagagtccttcggtctcaaggcagcaccctccgggtccagcagagacctcaaa attccaaggtgacacatatctcaagctgctttgggcacaagatagaccggatcggatccgtcagtcgtttgggctgtaacgcactgaagtt gttgtag Brain natriuretic peptide (BNP) Human (nucleic acid sequence):

(SEQ ID NO: 36)

atggatccccagacagcaccttcccgggcgctcctgctcctgctcttcttgcatctggctttcctgggaggtcgttcccaccgctgggca gccccggttcagcctcggacttggaaacgtccgggttacaggagcagcgcaaccatttgcagggcaaactgtcggagctgcaggtgg agcagacatccctggagcccctccaggagagcccccgtcccacaggtgtctggaagtcccgggaggtagccaccgagggcatccgt gggcaccgcaaaatggtcctctacaccctgcgggcaccacgaagccccaagatggtgcaagggtctggctgctttgggaggaagatg gaccggatcagctcctccagtggcctgggctgcaaagtgctgaggcggcattaa Renin Mouse (nucleic acid sequence):

(SEQ ID NO: 37)

atggacagaaggaggatgcctctctgggcactcttgttgctctggagtccttgcaccttcagtctcccaacacgcaccgctacctttgaac gaatcccgctcaagaaaatgccttctgtccgggaaatcctggaggagcggggagtggacatgaccaggctcagtgctgaatgggcg tattcacaaagaggccttccttgaccaatcttacctcccccgtggtcctcaccaactacctgaatacccagtactacggcgagattggcat cggtaccccacccagaccttcaaagtcatctttgacacgggttcagccaacctctgggtgccctccaccaagtgcagccgcctctacct tgcttgtgggattcacagcctctatgagtcctctgactcctccagctacatggagaacgggtccgacttcaccatccactacggatcagg gagagtcaaaggtttcctcagccaggactcggtgactgtgggtggaatcactgtgacacagacctttggagaggtcaccgagctgccc ctgatccctttcatgctggccaagtttgacggtgttctaggcatgggctttcccgctcaggccgttggcggggttacccctgtctttgacca cattctctcccaggggtgctaaaggaggaagtgttctctgtctactacaacaggggttcccacctgctgggggcgaggtggtgctag gaggtagcgacccgcagcattatcaaggcaattttcactatgtgagcatcagcaagactgactcctggcagatcacgatgaagggggt gtctgtggggtcttccaccctgctatgtgaagaaggctgtgcggtagtggtggacactggttcatcctttatctcggctcctacgagctccc tgaagttgatcatgcaagccctgggagccaaggagaagagaatagaagaatatgttgtgaactgtagccaggtgcccaccctccccga catttcctttgacctgggaggcagggcctacacactcagcagtacggactacgtgctacagtatcccaacaggagagacaagctgtgc acactggctctccatgccatggacatcccaccacccactgggcctgtctgggtcctgggtgccaccttcatccgcaagttctatacagag tttgatcggcataacaatcgcattggattcgccttggcccgctaa Renin Human (nucleic acid sequence):

(SEQ ID NO: 38)

atggatggatggagaaggatgcctcgctggggactgctgctgctgctctggggctcctgtacctttggtctcccgacagacaccaccac ctttaaacggatcttcctcaagagaatgcccctcaatccgagaaagcctgaaggaacgaggtgtggacatggccaggcttggtcccgagt ggagccaacccatgaagaggctgacacttggcaacaccacctcctccgtgatcctcaccaactacatggacacccagtactatggcga gattggcatcggcaccccaccccagaccttcaaagtcgtctttgacactggttcgtccaatgtttgggtgccctcctccaagtgcagccgt ctctacactgcctgtgtgtatcacaagctcttcgatgcttcggattcctccagctacaagcacaatggaacagaactcaccctccgctattc aacagggacagtcagtggctttctcagccaggacatcatcaccgtgggtggaatcacggtgacacagatgtttggagaggtcacggag atgcccgccttaccccttcatgctggccgagtttgatggggttgtgggcatgggcttcattgaacaggccattggcagggtcaccccatctct tcgacaacatcatctcccaaggggtgctaaaagaggacgtcttctctttctactacaacagagattccgagaattcccaatcgctgggag gacagattgtgctgggaggcagcgaccccagcattacgaagggaatttccactatatcaacctcatcaagactggtgtctggcagattc aaaatgaaggggtgtctgtggggtcatccaccttgctctgtgaagacggctgcctggcattggtagacaccggtgcatcctacatctcag gttctaccagctccatagagaagctcatggaggccttgggagccaagaagaggctgtttgattatgtcgtgaagtgtaacgagggccct acactccccgacatctcttttccacctgggaggcaaagaatacacgctcaccagcgcggactatgtatttcaggaatcctacagtagtaaa aagctgtgcacactggccatccacgccatggatatcccgccacccactggacccacctgggcctgggggccaccttcatccgaaagt tctacacagagtttgatcggcgtaacaaccgcattggcttcgccttggcccgctga -continued Galanin Mouse (nucleic acid sequence):
(SEQ ID NO: 39)
atggccagaggcagcgttatcctgctaggctggctcctgttggttgtgaccctgtcagccactctgggacttgggatgcctgcaaagga gaagagaggttggaccctgaacagcgctggctaccttctgggcccacatgccattgacaaccacagatcatttagcgacaagcatggc ctcacaggcaagagggagttacaactggaggtggaggaaaggagaccaggaagtgttgatgtgcccctgcctgagagcaacattgtc cgcactataatggagtttctcagtttcttgcacctttaaagaggccggggccctcgacagcctgcctggcatccccttggccacctcctcag aagacctagagaagtcctga Galanin Human (nucleic acid sequence):
(SEQ ID NO: 40)
atggcccgaggcagcgcccctcctgctcgcctcccctcctcctcgccgcggccctttctgcctctgcgggggctctggtcgccggccaagg aaaaacgaggctggaccctgaacagcgcgggctacctgctgggcccacatgccgttggcaaccacaggtcattcagcgacaagaat ggcctcaccagcaagcgggagctgcgcccgaagatgacatgaaaccaggaagctttgacaggtccatacctgaaaacaatatcatg cgcacaatcattgagtttctgtctttcttgcatctcaaagaggccggtgccctcgaccgcctcctggatctccccgccgcagcctcctcag aagacatcgagcggtcctga Orexin Mouse (nucleic acid sequence):
(SEQ ID NO: 41)
atgaactttccttctacaaaggttccctgggccgccgtgacgctgctgctgctgctactgctgccgccggcgctgctgtcgcttggggtg gacgcacagcctctgcccgactgctgtcgccagaagacgtgttcctgccgtctctacgaactgttgcacggagctggcaaccacgctg cgggtatcctgactctgggaaagcggcggcctggacctccaggcctccagggacggctgcagcgcctccttcaggccaacggtaac cacgcagctggcatcctgaccatgggccgccgcgcaggcgcagagctagagccacatccctgctctggtcgcggctgtccgaccgt aactaccaccgctttagcaccccggggagggtccggagtctga Orexin Human (nucleic acid sequence):
(SEQ ID NO: 42)
atgaaccttccttccacaaaggtctcctgggccgccgtgacgctactgctgctgctgctgtgccgcccgcgctgttgtcgtccggg gcggctgcacagcccctgcccgactgctgtcgtcaaaagacttgctcttgccgcctctacgagctgctgcacggcgcgggcaatcacg cggccggcatcctcacgctgggcaagcggaggtccgggccccgggcctccagggtcggctgcagcgcctcctgcaggccagcg gcaaccacgccgcgggcatcctgaccatgggccgccgcgcaggcgcagagccagcgccgcgcccctgcctcgggcgccgctgtt ccgcccggccgccgcctccgtcgcgcccggaggacagtccgggatctga Ghrelin-Obestatin Mouse (nucleic acid sequence):
(SEQ ID NO: 43)
atgctgtcttcaggcaccatctgcagtttgctgctactcagcatgctctggatggacatggccatggcaggctccagcttcctgagcccag agcaccagaaagcccagcagagaaaggaatccaagaagccaccagctaaactgcagccacgagctctggaaggctggctccaccc agaggacagaggacaagcagaagagacagaggaggagctggagatcaggttcaatgctcccttcgatgttggcatcaagctgtcag gagctcagtatcagcagcatggccgggccctggggaagtttcttcaggatatcctctgggaagaggtcaaagaggcgccagctgaca agtaa Ghrelin-Obestatin Human (nucleic acid sequence):
(SEQ ID NO: 44)
atgccctccccagggaccgtctgcagcctcctgctcctcggcatgctctggctggacttggccatggcaggctccagcttcctgagccc tgaacaccagagagtccagagaaaggagtcgaagaagccaccagccaagctgcagccccgagctctagcaggctggctccgcccg gaagatggaggtcaagcagaaggggcagaggatgaactggaagtccggttcaacgcccccttttgatgttggatcaagctgtcaggg gttcagtaccagcagcacagccaggccctggggaagtttcttcaggacatcctctgggaagaggccaaagaggcccccagccgacaa gtga Cholecystokinin Mouse (nucleic acid sequence):
(SEQ ID NO: 45)
atgaagagcggcgtatgtctgtgcgtggtgatggcagtcctagctgctggcgccctggcgcagccggtagtccctgcagaagctacgg accccgtggagcagcgggcgcaagaggcgccccgaaggcagctgcgggctgtgctccggacggacggcgagcccgagcgcg cctgggcgcactgctagcgcgatacatccagcaggtccgcaaaagctccttctggccgcatgtccgttcttaagaacctgcagagcctgg -continued accccagccatagaataagtgaccgggactacatgggctggatggattttggccggcgcagtgccgaggactacgaataccatcgta
g Cholecystokinin Human (nucleic acid sequence):

(SEQ ID NO: 46)

atgaacagcggcgtgtgcctgtgcgtgctgatggcggtactggcggctggcgccctgacgcagccggtgcctcccgcagatcccgc gggctccgggctgcagcgggcagaggaggcgcccgtaggcagctgagggtatcgcagagaacggatggcgagtcccgagcgc acctgggcgccctgctggcaagatacatccagcaggcccggaaagctcctttctggacgaatgtccatcgttaagaacctgcagaacct ggaccccagccacaggataagtgaccgggactacatgggctggatggattttggccgtcgcagtgccgaggagtatgagtaccccctc ctag Gastrin Mouse (nucleic acid sequence):

(SEQ ID NO: 47)

atgcctcgactgtgtgtgtacatgctggtcttagtgctggctctagctaccttctcggaagcttcttggaagccccgctcccagctacagga tgcatcatctggaccagggaccaatgaggacctggaacagcgccagttcaacaagctgggctcagcctctcaccatcgaaggcagct ggggccccagggtcctcaacacttcatagcagacctgtccaagaagcagaggccacgaatggaggaagaagaagaggcctacgga tggatggactttggccgccgcagtgctgaggaagaccagtag Gastrin Human (nucleic acid sequence):

(SEQ ID NO: 48)

atgcagcgactatgtgtgtatgtgctgatctttgcactggctctggccgccttctctgaagcttcttggaagccccgctcccagcagccag atgcacccttaggtacaggggccaacagggacctggagctaccctggctggagcagcagggcccagcctctcatcatcgaaggcag ctgggaccccagggtccccacacctcgtggcagacccgtccaagaagcagggaccatggctggaggaagaagaagaagcctatg gatggatggacttcggccgccgcagtgctgaggatgagaactaa Protachykinin-1 (Substance P, Neurokinin A, Neuropeptide K, Neuropeptide gamma) Mouse
(nucleic acid sequence):

(SEQ ID NO: 49)

atgaaaatcctcgtggccgtggcggtctttttttctcgtttccactcaactgtttgcagaggaaatcgatccaacgatgatctaaattattggt ccgactggtccgacagtgaccagatcaaggaggcaatgccggagccctttgagcatcttctgcagagaatcgcccgaagacccaagc ctcagcagttctttggattaatgggcaagcgggatgctgattcctcagttgaaaaacaagtggccctgttaaaggctctttatggacatggc cagatctctcacaaaaggcataaaacagattcctttgttggactaatgggcaaagagctttaaattctgtggcttatgaaagaagcgcga tgcagaactacgaaagaagacgtaaataa Protachykinin-1 (Substance P, Neurokinin A, Neuropeptide K, Neuropeptide gamma) Human
(nucleic acid sequence):

(SEQ ID NO: 50)

atgaaaatcctcgtggccttggcagtctttttttcttgtctccactcagctgtttgcagaagaaataggagccaatgatgatctgaattactggt ccgactggtacgacagcgaccagatcaaggaggaactgccggagccctttgagcatcttctgcagagaatcgcccggagacccaag cctcagcagttctttggattaatgggcaaacgggatgctgattcctcaattgaaaaacaagtggccctgttaaaggctctttatggacatgg ccagatctctcacaaaagacataaaacagattcctttgttggactaatgggcaaagagctttaaattctgtggcttatgaaaggagtgcaa tgcagaattatgaaagaagacgttaa Proenkephalin-A Mouse (nucleic acid sequence):

(SEQ ID NO: 51)

atggcgcggttcctgaggctttgcacctggctgctggcgcttgggtcctgcctcctggctacagtgcaggcggaatgcagccaggact gcgctaaatgcagctaccgcctggttcgcccaggcgacatcaatttcctggcgtgcacactggaatgtgaaggacagctgccttctttca aaatctgggagacctgcaaggatctcctgcaggtgtccaggcccgagttcccttgggataacatcgacatgtacaaagacagcagcaa acaggatgagagccacttgctagccaagaagtacggaggcttcatgaaacggtacgaggcttcatgaagaagatggacgagctatat cccatggagccagaagaagaagcgaacggaggagagatccttgccaagaggtatggcggcttcatgaagaaggatgcagatgagg gagacaccttggccaactcctccgatctgctgaaagagctactgggaacgggagacaaccgtgcgaaagacagccaccaacaagag agcaccaacaatgacgaagacatgagcaagaggtatggggggcttcatgagaagcctcaaaagaagccccaactggaagatgaagc aaaagagctgcagaagcgctacggggggcttcatgagaaagggtgggacgccccgagtggtggatggactaccagaagaggtatggg

```
ggcttcctgaagcgctttgctgagtctctgccctccgatgaagaaggcgaaaattactcgaaagaagttcctgagatagagaaaagatac
gggggctttatgcggttctga
```

Proenkephalin-A Human (nucleic acid sequence):

(SEQ ID NO: 52)

```
atggcgcggttcctgacactttgcacttggctgctgttgctcggccccgggctcctggcgaccgtgcgggccgaatgcagccaggattg
cgcgacgtgcagctaccgcctagtgcgcccggccgacatcaacttcctggcttgcgtaatggaatgtgaaggtaaactgccttctctga
aaattgggaaacctgcaaggagctcctgcagctgtccaaaccagagcttcctcaagatggcaccagcaccctcagagaaaatagcaa
accggaagaaagccatttgctagccaaaaggtatgggggcttcatgaaaaggtatggaggcttcatgaagaaaatggatgagctttatc
ccatggagccagaagaagaggccaatggaagtgagatcctcgccaagcggtatgggggcttcatgaagaaggatgcagaggagga
cgactcgctggccaattcctcagacctgctaaaagagcttctggaaacaggggacaaccgagagcgtagccaccaccaggatggca
gtgataatgaggaagaagtgagcaagagatatgggggcttcatgagaggcttaaagagaagcccccaactggaagatgaagccaaa
gagctgcagaagcgatatgggggcttcatgagaagagtaggtcgcccagagtggtggatggactaccagaaacggtatggaggtttc
ctgaagcgctttgccgaggctctgccctccgacgaagaaggcgaaagttactccaaagaagttcctgaaatggaaaaaagatacggag
gatttatgagattttaa
```

Proenkephalin-B Mouse (nucleic acid sequence):

(SEQ ID NO: 53)

```
atggcgtggtccaggctgatgctggcagcttgcctcctcgtgatgccctctaatgttatggcggactgcctgtccctgtgctccctgtgtgc
agtgaggattcaggatgggcccgtcccatcaacccctgatttgctccctggagtgccaggacctggtgccgccctcagaggagtgg
gagacatgccgggcttctcatctttctcaccctgacggtctctgggctccgtggcaaggatgacttggaagatgaggttgctttggaag
aaggctacagtgcactagccaagctcttggaacccgtcctgaaggagctggagaaaagccgactcccttaccagcgtcccagaggaaa
agttcaggggtctctccagcagctttggcaacggaaaagaatctgagctggcgggtgctgaccggatgaatgatgaagccgcacagg
cgggcacgctccattttaatgaggaggacttgagaaaacaggccaaacgctatggcggcttttttgcgcaaatacccaagaggagttcc
gagatggcccgggatgaggacggggggccaggatggggatcaggtagggcatgaggacctgtacaaacgctatgggggcttcctgc
ggcgcattcgccccaagctgaagtgggacaaccagaagcgctatggtggtttcctgcggcgtcagttcaaggtggtgacgcggtccca
ggagaaccccaatacctattctgaagatttagatgtttga
```

Proenkephalin-B Human (nucleic acid sequence):

(SEQ ID NO: 54)

```
atggcctggcaggggctggtcctggctgcctgcctcctcatgttcccctccaccacagcggactgcctgtcgcggtgctccttgtgtgct
gtaaagacccaggatggtcccaaacctatcaatcccctgatttgctccctgcaatgccaggctgccctgctgccctctgaggaatggga
gagatgccagagctttctgtctttttttcaccccctccacccttgggctcaatgacaaggaggacttggggagcaagtcggttggggaagg
gccctacagtgagctggccaagctctctgggtcattcctgaaggagctggagaaaagcaagtttctcccaagtatctcaacaaaggaga
acactctgagcaagagcctggaggagaagctcaggggtctctctgacgggtttaggagggagcagagtctgagctgatgagggatg
cccagctgaacgatggtgccatggagactggcacactctatctcgctgaggaggaccccaaggagcaggtcaaacgctatgggggct
ttttgcgcaaataccccaagaggagctcagaggtggctggggagggggacggggatagcatgggccatgaggacctgtacaaacgc
tatgggggcttcttgcggcgcattcgtcccaagctcaagtgggacaaccagaagcgctatggcggttttctccggcgccagttcaaggt
ggtgactcggtctcaggaagatccgaatgcttactctggagagctttttgatgcataa
```

Insulin-like growth hormone 1 (IGF-1) Mouse (nucleic acid sequence):

(SEQ ID NO: 55)

```
atggggaaaatcagcagccttccaactcaattatttaagatctgcctctgtgacttcttgaagataaagatacacatcatgtcgtcttcacac
ctcttctacctggcgctctgcttgctccacttcaccagctccaccacagctggaccagagacccctttgcggggctgagctggtggatgct
cttcagttcgtgtgtggaccgaggggcttttacttcaacaagcccacaggctatggctccagcattcggagggcaccctcagacaggcatt
gtggatgagtgttgcttccggagctgtgatctgaggagactggagatgtactgtgccccactgaagcctacaaaagcagcccgctctat
ccgtgcccagcgccacactgacatgcccaagactcagaagtccccgtccctatcgacaaacaagaaaacgaagctgcaaaggagaa
ggaaaggaagtacatttgaagaacacaagtag
```

Insulin-like growth hormone 1 (IGF-1) Human (nucleic acid sequence):
(SEQ ID NO: 56)
atggaaaaatcagcagtcttccaacccaattatttaagtgctgcttttgtgatttcttgaaggtgaagatgcacaccatgtcctcctcgcatc tcttctacctggcgctgtgcctgctcaccttcaccagctctgccacggctggaccggagacgctgctgcggggctgagctggtggatgct cttcagttcgtgtgtggagacaggggcttttatttcaacaagcccacagggtatggctccagcagtcggagggcgcctcagacaggcat cgtggatgagtgctgcttccggagctgtgatctaaggaggctggagatgtattgcgcacccctcaagcctgccaagtcagctcgctctgt ccgtgcccagcgccacaccgacatgcccaagacccagaagtatcagccccatctaccaacaagaacacgaagtctcagagaagga aaggaagtacatttgaagaacgcaagtag Insulin-like growth hormone 2 (IGF-2) Mouse (nucleic acid sequense):
(SEQ ID NO: 57)
atgggcggcagcgtcgccggcttccaggtaccaatggggatcccagtggggaagtcgatgttggtgcttctcatctctttggccttcgcc ttgtgctgcatcgctgcttacggccccggagagactctgtgcggaggggagcttgttgacacgcttcagtttgtctgttcggaccgcggc ttctacttcagcaggccttcaagccgtgccaaccgtcgcagccgtggcatcgtggaagagtgctgcttccgcagctgcgacctggccct cctggagacatactgtgccaccccgccaagtccgagagggacgtgtctacctctcaggccgtacttccggacgacttccccagatac cccgtgggcaagttcttccaatatgacacctggagacagtccgcggggacgcctgcgcagaggcctgcctgccctcctgcgtgcccgc cggggtcgcatgcttgccaaagagctcaaagagttcagagaggccaaacgtcatcgtcccctgatcgtgttaccacccaaagaccccg cccacggggagcctcttcggagatgtccagcaaccatcagtga Insulin-like growth hormone 2 (IGF-2) Human (nucleic acid sequence):
(SEQ ID NO: 58)
atgggaatcccaatggggaagtcgatgctggtgcttctcaccttcttggccttcgcctcgtgctgcattgctgcttaccgccccagtgaga ccctgtgcggcggggagctggtggacaccctccagttcgtctgtggggaccgcggcttctacttcagcaggcccgcaagccgtgtga gccgtcgcagccgtggcatcgttgaggagtgctgtttccgcagctgtgacctggccctcctggagacgtactgtgctaccccgccaag tccgagagggacgtgtcgaccctccgaccgtgcttccggacaacttccccagataccccgtgggcaagttcttccaatatgacacctg gaagcagtccacccagcgcctgcgcaggggcctgcctgccctcctgcgtgcccgccggggtcacgtgctcgccaaggagctcgag gcgttcagggaggccaaacgtcaccgtcccctgattgctctacccacccaagaccccgcccacggggcgccccccagagatggc cagcaatcggaagtga Parathyroid hormone (PTH) Mouse (nucleic acid sequence):
(SEQ ID NO: 59)
atgatgtctgcaaacaccgtggctaaagtgatgatcatcatgctggcagtctgtcttcttacccaaacggatgggaaacccgtgaggaag agagctgtcagtgaaatacagcttatgcacaacctgggcaaacacctggcctccatggagaggatgcaatggctgagaaggaagctg caagatatgcacaattttgttagtcttggagtccaaatggctgccagagatggcagtcaccagaagcccaccaagaaggaggaaaatgt ccttgttgatggcaatccaaaaagtcttggtgagggagacaaagctgatgtggatgtattagttaaatcaaaatctcagtaa Parathyroid hormone (PTH) Human (nucleic acid sequence):
(SEQ ID NO: 60)
atgatacctgcaaaagacatggctaaagttatgattgtcatgttggcaatttgttttcttacaaaatcggatgggaaatctgttaagaagagat ctgtgagtgaaatacagcttatgcataacctgggaaaacatctgaactcgatgagagagtagaatggctgcgtaagaagctgcaggat gtgcacaattttgttgcccttggagctcctctagctcccagagatgctggttcccagaggccccgaaaaaaggaagacaatgtcttggttg agagccatgaaaaagtcttggagaggcagacaaagctgatgtgaatgtattaactaaagctaaatcccagtga Parathyroid hormone-related protein (PTHrP) Mouse (nucleic acid sequence):
(SEQ ID NO: 61)
atgctgcgcgaggctggttcagcagtggagtgtcctggtattcctgctcagctactccgtgccctcccgcggggcgttcggtggaggggct tggccgcaggctcaaacgcgctgtgtctgaacatcagctactgcatgacaagggcaagtccatccaagacttgcgccgccgtttcttcct ccaccatctgatcgcggagatccacacagccgaaatcagagctacctcggaggtgtcccccaactccaaacctgctcccaacaccaaa aaccaccccgtgcggtttgggtcagacgatgagggcagataccctaactcaggaaaccaacaaggtgggagacgtacaagaacagcc actcaagacacccgggaagaagaagaaaggcaagcctgggaaacgcagagaacaggagaaaaagaagcgaaggactcggtctg cctggccaagcacagctgcgagtggcctgcttgaggacccctgccccacacctccaggccctcgctggagcccagcttaaggacg cattga -continued Parathyroid hormone-related protein (PTHrP) Human (nucleic acid sequence):

(SEQ ID NO: 62)

atgcagcggagactggttcagcagtggagcgtcgcggtgttcctgctgagctacgcggtgccctcctgcgggcgctcggtggaggt
ctcagccgccgcctcaaaagagctgtgtctgaacatcagctcctccatgacaaggggaagtccatccaagatttacggcgacgattcttc
cttcaccatctgatcgcagaaatccacacagctgaaatcagagctacctcggaggtgtccctaactccaagccctctcccaacacaaa
gaaccaccccgtccgatttgggtctgatgatgagggcagataccaactcaggaaactaacaaggtggagacgtacaaagagcagcc
gctcaagacacctgggaagaaaaagaaaggcaagcccgggaaacgcaaggagcaggaaaagaaaaaacggcgaactcgctctgc
ctggttagactctggagtgactgggagtgggctagaaggggaccacctgtctgacacctccacaacgtcgctggagctcgattcacgg
aggcattga Osteocalcin Mouse (nucleic acid sequence):

(SEQ ID NO: 63)

atgaggaccatctttctgctcactctgctgaccctggctgcgctctgtctctctgacctcacagatgccaagcccagcggccctgagtctg
acaaagccttcatgtccaagcaggagggcaataaggtagtgaacagactccggcgctaccttggagcctcagtccccagcccagatc
ccctggagcccacccgggagcagtgtgagcttaaccctgcttgtgacgagctatcagaccagtatggcttgaagaccgcctacaaacg
catctatggtatcactatttag Osteocalcin Human (nucleic acid sequence):

(SEQ ID NO: 64)

atgagagccctcacactcctcgccctattggccctggccgcactttgcatcgctggccaggcaggtgcgaagcccagcggtgcagagt
ccagcaaaggtgcagccttttgtgtccaagcaggagggcagcgaggtagtgaagagacccaggcgctacctgtatcaatggctggga
gccccagtcccctacccggatcccctggagcccaggaggaggtgtgtgagctcaatccggactgtgacgagttggctgaccacatc
ggctttcaggaggcctatcggcgcttctacggcccggtctag Urocortin-3 Mouse (nucleic acid sequence):

(SEQ ID NO: 65)

atgctgatgcccacctacttcctgctgccacttctgctgctcctaggaggtccaaggacaagcctctcccacaagttctacaacactggac
cagtcttcagctgcctcaacacagccctatctgaggtcaagaagaacaagctggaagatgtgcccttgctgagcaagaagagctttggc
cacctgcccacacaagacccctcaggggaagaagatgacaaccaaacgcacctccagatcaaaagaactttctcaggtgccgcgggt
gggaatggagctgggagcacccggtacagataccaatcccaggcacagcacaaggggaagctgtacccagacaagcccaaaagc
gaccggggcaccaagttcaccctttcccttgatgttcccactaacatcatgaacatcctcttcaacatcgacaaggccaagaatttgcgag
ccaaggcagctgccaatgctcagctcatggcacagattgggaagaagaagtaa Urocortin-3 Human (nucleic acid sequence):

(SEQ ID NO: 66)

atgctgatgccggtccacttcctgctgctcctgctgctgctcctgggggcccaggacaggcctcccccacaagttctacaaagccaa
gcccatcttcagctgcctcaacaccgccctgtctgaggctgagaagggccagtgggaggatgcatccctgctgagcaagaggagcttc
cactacctgcgcagcagagacgcctcttcgggagaggaggaggagggcaaagagaaaaagactttcccccatctctggggccaggg
gtggagccagaggcacccggtacagatacgtgtcccaagcacagcccaggggaaagccacgccaggacacggccaagagtcccc
accgccaagttcaccctgtccctcgacgtccccaccaacatcatgaacctcctcttcaacatcgccaaggccaagaacctgcgtgcc
caggcggccgccaatgcccacctgatggcgcaaattgggaggaagaagtag Urocortin-2 Mouse (nucleic acid sequence):

(SEQ ID NO: 67)

atgatgaccaggtgggcactggtggtgttcgtggtcctgatgttggataggatcctatttgtcccaggaactcctatccccaccttccagct
cctccctcagaactctctggagacaactcctagctctgtgacctcagagagctcctcaggtaccaccacaggaccctcagcttcctgga
gcaactctaaagccagcccttacctagacaccgtgtcatactctccctggatgttcccattggcctcctacggatcttactggaacaggc
tcgttacaaggctgccaggaatcaggctgccactaatgctcaaatactagcccatgttggccgccgctga Urocortin-2 Human (nucleic acid sequence):

(SEQ ID NO: 68)

atgaccaggtgtgctctgctgttgctgatggtcctgatgttgggcagagtcctggttgtcccagtgaccccatcccaaccttccagctccg
ccctcagaattctccccagaccactccccgacctgcggcctcagagagccctcagctgctcccacatggccgtgggctgcccagag -continued ccactgcagccccacccgccaccctggctcgcgcattgtcctatcgctggatgtccccatcggcctcttgcagatcttactggagcaagc ccgggccagggctgccaggagcaggccaccaccaacgcccgcatcctggcccgtgtcggccactgctga Urocortin-1 Mouse (nucleic acid sequence):

(SEQ ID NO: 69)

atgatacagaggggacgcgctacgctcctggtggcgttgctgctgctcttggcacagcttcgcccggagagcagccagtggagcccagcg gctgcggcggcaactggggtccaggatccgaatctgcgatggagccctggagtgcggaatcagggcggcggcgtccgcgcgctcc tcttgctgttagcggagcgcttcccgcgccgcgcaggatctgagcctgcgggcgagcggcagcgacgggacgaccctccactgtcc atcgacctcaccttccacctgctgcggaccctgctggagctagctcggacacagagccagcgcgagcgcgcagagcagaaccgcat catattcgattcggtgggcaagtga Urocortin-1 Human (nucleic acid sequence):

(SEQ ID NO: 70)

atgaggcaggcggggacgcgcagcgctgctggccgcgctgctgctcctggtacagctgtgccctgggagcagccagaggagccccg aggcggccggggtccaggacccgagtctgcgctggagccccggggcacggaaccagggtggcggggcccgcgcgctcctcttgc tgctggcggagcgcttcccgcgccgcgcggggccggccgattgggactcgggacggcaggcgagcggccgcggcgggacaac ccttctctgtccattgacctcacctttcacctgctgcggaccctgctggagctggcgcggacgcagagccagcgggagcgcgccgagc agaaccgcatcatattcgactcggtgggcaagtga FGF23 Mouse (nucleic acid sequence):

(SEQ ID NO: 71)

Atgctagggacctgccttagactcctggtgggcgtgctctgcactgtctgcagcttgggcactgctagagcctatccggacacttcccc attgcttggctccaactggggaagcctgacccacctgtacacggctacagccaggaccagctatcacctacagatccataggatggtc atgtagatggcacccccatcagaccatctacagtgccctgatgattacatcagaggacgccggctctgtggtgataacaggagccatg actcgaaggttcctttgtatggatctccacggcaacattttttggatcgcttcacttcagcccagagaattgcaagttccgccagtggacgct ggagaatggctatgacgtctacttgtcgcagaagcatcactacctggtgagcctgggccgcgccaagcgcatcttccagccgggcacc aacccgccgcccttctcccagttcctggctcgcaggaacgaggtcccgctgctgcatttctacactgttcgcccacggcgccacacgcg cagcgccgaggaccccaccggagcgcgaccccactgaacgtgctcaagccgcggccccgcgccacgcctgtgcctgtatcctgctctc gcgagctgccgagcgcagaggaaggtggccccgcagccagcgatcctctgggggtgctgcgcagaggccgtggagatgctcgcg ggggcgcgggaggcgcggataggtgtcgcccctttcccaggttcgtctag FGF23 Human (nucleic acid sequence):

(SEQ ID NO: 72)

Atgagggggcccgcctcaggctctgggtctgtgccttgtgcagcgtctgcagcatgagcgtcctcagagcctatcccaatgcctcccc actgctcggctccagctgggggtggcctgatccacctgtacacagccacagccaggaacagctaccacctgcagatccacaagaatgg ccatgtggatggcgcaccccatcagaccatctacagtgccctgatgatcagatcagaggatgctggctttgtggtgattacaggtgtgat gagcagaagatacctctgcatggatttcagaggcaacattttttggatcacactatttcgacccggagaactgcaggttccaacaccagac gctggaaaacgggtacgacgtctaccactctcctcagtatcacttcctggtcagtctgggccgggcgaagagagccttcctgccaggca tgaacccaccccgtactcccagttcctgtcccggaggaacgagatcccctaattcacttcaacaccccataccacggcggcacac ccggagcgccgaggacgactcggagcgggaccccctgaacgtgctgaagcccgggcccggatgaccccggccccggcctcctg ttcacaggagctcccgagcgccgaggacaacagcccgatggccagtgacccattaggggtggtcaggggcggtcgagtgaacacg cacgctgggggaacgggcccggaaggctgccgccccttcgccaagttcatctag IL1B Mouse (nucleic acid sequence):

(SEQ ID NO: 73)

Atggcaactgttcctgaactcaactgtgaaatgccaccttttgacagtgatgagaatgacctgttctttgaagttgacggacccaaaaga tgaagggctgcttccaaaccttgacctgggctgtcctgatgagagcatccagcttcaaatctcgcagcagcacatcaacaagagcttca ggcaggcagtatcactcattgtggctgtgagaagctgtggcagctacctgtgctttcccgtggaccttccaggatgaggacatgagca ccttcttttccttcatcttgaagaagagcccatcctctgtgactcatgggatgatgatgataacctgctggtgtgtgacgttcccattagaca actgcactacaggctccagatgaacaacaaaaagcctcgtgctgtcggacccatatgagctgaaagctctccacctcaatggacag aatatcaaccaacaagtgatattctccatgagctttgtacaaggagaaccaagcaacgacaaaatacctgtggccttgggcctcaaagg -continued aaagaatctatacctgtcctgtgtaatgaaagacggcacacccaccctgcagctggagagtgtggatcccaagcaatacccaaagaag aagatggaaaaacggtttgtcttcaacaagatagaagtcaagagcaagtggagtttgagtctgcagagttccccaactggtacatcagc acctcacaagcagagcacaagcctgtcttcctgggaaacaacagtggtcaggacataattgacttcaccatggaatccgtgtcttcctaa IL1B Human (nucleic acid sequence):

(SEQ ID NO: 74)

Atggcagaagtacctgagctcgccagtgaaatgatggcttattacagtggcaatgaggatgacttgttcttttgaagctgatggccctaaa cagatgaagtgctccttccaggacctggacctctgccctctggatggcggcatccagctacgaatctccgaccaccactacagcaagg gcttcaggcaggccgcgtcagttgttgtggccatggacaagctgaggaagatgctggttccctgcccacagaccttccaggagaatga cctgagcaccttctttcccttcatctttgaagaagaacctatcttcttcgacacatgggataacgaggcttatgtgcacgatgcacctgtacg atcactgaactgcacgctccgggactcacagcaaaaaagcttggtgatgtctggtccatatgaactgaaagctctccacctccagggac aggatatggagcaacaagtggtgttctccatgtcctttgtacaaggagaagaaagtaatgacaaaatacctgtggccttgggcctcaagg aaaagaatctgtacctgtcctgcgtgttgaaagatgataagcccactctacagctggagagtgtagatcccaaaaattacccaaagaaga agatggaaaagcgatttgtcttcaacaagatagaaatcaataacaagctggaatttgagtctgcccagttccccaactggtacatcagcac ctctcaagcagaaaacatgcccgtcttcctggggagggaccaaaggcggccaggatataactgacttcaccatgcaatttgtgtcttccta a TNFA Mouse (nucleic acid sequence):

(SEQ ID NO: 75)

Atgagcacagaaagcatgatccgcgacgtggaactggcagaagaggcactcccccaaaagatggggggcttccagaactccaggc ggtgcctatgtctcagcctcttctcattcctgcttgtggcaggggccaccacgctcttctgctactgaacttcggggtgatcggtccccaa agggatgagaagttcccaaatggcctccctctcatcagttctatggcccagaccctcaca<u>ctcagat</u>catcttctcaaaattcgagtgaca agcctgtagcccacgtcgtagcaaaccaccaagtggaggagcagctggagtggctgagccagcgcgccaacgccctcctggccaa cggcatggatctcaaagacaaccaactagtggtgccagccgatgggttgtaccttgtctactcccaggttctcttcaagggacaaggctg ccccgactacgtgctcctcacccacaccgtcagccgatttgctatctcataccaggagaaagtcaacctcctctctgccgtcaagagccc ctgccccaaggacacccctgaggggctgagctcaaaccctggtatgagcccatatacctgggaggagtcttccagctggagaaggg ggaccaactcagcgctgaggtcaatctgcccaagtacttagactttgcggagtccgggcaggtctactttggagtcattgctctgtga TNFA Human (nucleic acid sequence):

(SEQ ID NO: 76)

Atgagcactgaaagcatgatccgggacgtggagctggccgaggaggcgctccccaagaagacaggggggccccagggctccag gcggtgcttgttcctcagcctcttctccttcctgatcgtggcaggcgccaccacgctcttctgcctgctgcactttggagtgatcggcccc agagggaagagttccccagggacctctctctaatcagccctctggcccaggca<u>gtcagat</u>catcttctcgaaccccgagtgacaagcct gtagcccatgttgtagcaaaccctcaagctgaggggcagctccagtggctgaaccgccgggcaatgcccctcctggccatggcgtg gagctgagagataaccagctggtggtgccatcagagggcctgtacctcatctactcccaggtcctcttcaagggccaaggctgccctc cacccatgtgctcctcacccacaccatcagccgcatcgccgtctcctaccagaccaaggtcaacctcctctctgccatcaagagcccct gccagagggagaccccagaggggctgagccaagccctggtatgagcccatctatctgggagggtcttccagctggagaagggt gaccgactcagcgctgagatcaatcggcccgactatctcgactttgccgagtctgggcaggtctactttggatcattgccctgtga IFNG Mouse (nucleic acid sequence):

(SEQ ID NO: 77)

Atgaacgctacacactgcatcttggctttgcagctcttcctcatggctgtttctggctgttactgccacggcacagtcattgaaagcctaga aagtctgaataactattttaactcaagtggcatagatgtggaagaaaagagtctcttcttggatatctggaggaactggcaaaaggatggt gacatgaaaatcctgcagagccagattatctctttctacctcagactcttttgaagtcttgaaagacaatcaggccatcagcaacaacataa gcgtcattgaatcacacctgattactaccttcttcagcaacagcaaggcgaaaaaggatgcattcatgagtattgccaagtttgaggtcaa caacccacaggtccagcgccaagcattcaatgagctcatccgagtggtccaccagctgttgccggaatccagcct<u>aggaagcggaa</u>

<u>a</u>aggagtcgctgctga

IFNG Human (nucleic acid sequence):

(SEQ ID NO: 78)
Atgaaatatacaagttatatcttggcttttcagctctgcatcgttttgggttctcttggctgttactgccaggacccatatgtaaaagaagcag
aaaaccttaagaaatattttaatgcaggtcattcagatgtagcggataatggaactcttttcttaggcattttgaagaattggaaagaggaga
gtgacagaaaaataatgcagagccaaattgtctccttttacttcaaacttttaaaaactttaaagatgaccagagcatccaaaagagtgtg
gagaccatcaaggaagacatgaatgtcaagttttttcaatagcaacaaaaagaaacgagatgacttcgaaaagctgactaattattcggta
actgacttgaatgtccaacgcaaagcaatacatgaactcatccaagtgatggctgaactgtcgccagcagctaaaacagggaagcgaa
aaaggagtcagatgctgtttcgaggtcgaagagcatcccagtaa Sortilin Mouse (nucleic acid sequence):

(SEQ ID NO: 79)
Atggagcggcccgggggagctgcggacggccttttgcgctggcccctcggcctcctcctgctccttcaactgctgcctcctgccgccg
tcggccaggaccggctggacgcgccgccgccgccgcgcctcctctgctgcgctgggccggtccggtcggggtgagctgggggct
gcgcgccgccgcgcccgggggccccgtcccccgcgctggccgttggcgccgcggcgcgcccgccgaggaccaagactgcggcc
gcctcccggacttcatcgccaagctgaccaacaatacgcaccagcatgtctttgatgacctcagtggctcagtgtccttgtcctgggttgg
agacagcactggggttattctcgtcctgaccactttccaagtgcctctggtaattgtgagctttggacagtccaagttgtatcgaagtgagg
attatgaaagaactttaaggatattacaaatctcatcaataacaccttcattcggacggaatttggcatggctattggtcctgagaactctg
gaaaggtgatactaacagcggaggtgtccggggggaagccgaggcggaagagtgttcaggtcatcagactttgccaagaactttgtgc
aaacagatctccccttcatcctctgacgcagatgatgtacagccctcagaattctgattacctgttagctctcagcaccgaaaatggcctg
tgggtgtccaagaattttgggaaaaatgggaagaaatccacaaagcagtatgtttggccaaatggggaccaaacaacatcatcttcttt
accacccatgtgaatggctcctgcaaagctgatcttggtgccctggaattatgggagaacatccgacttgggaaaaaccttcaaaaccatt
ggtgtgaaaatctactcctttggtcttggggggccgtttccttttttgcctctgtgatggctgataaggacacaacaagaaggatccatgtgtca
acagaccaggggggacacatggagcatggcacaacttccttctgtgggacaggaacagttctactccatcctggcagccaatgaggaca
tggtcttcatgcatgtagatgaacctggagataccgggttttggcaccatcttttacctctgatgatcgaggcattgtctactccaagtctctgg
acagacatctctataccaccacaggcggggagacggactttaccaacgtgacttccctccgtggggtctatataacaagcacgctctca
gaagataactctattcagagcatgatcactttttgaccagggaggacggtgggagcacctgcggaagccggagaacagcaagtgcgac
gctaccgcaaagaacaagaacgagtgcagccttcatatccatgcttcttatagcatctcccagaagctaaacgttccaatggccccacttt
ccgagcccaatgctgtgggcatagtcatcgctcacggtagtgtgggagatgccatctcggtgatggtcccagatgtgtacatctcagatg
atgggggttactcctgggcgaagatgctagaaggaccacattactataccatcctggactctggaggcatcattgtggccattgagcaca
gcaaccgtcctatcaatgtgattaagttctccacagatgaaggccagtgctggcagagctatgtgttcacacaggagcccatctacttcac
tgggcttgcttccgagcctggagccaggtccatgaacatcagcatctgggattcacagagtctttcattcccgccagtgggtctcctac
acagtcgatttcaaagacatccttgagcggaattgtgaagaggatgactataccacgtggctggcacactccacagaccctggagatta
caaagacggctgcattttgggctataaagaacagttcctacggctacggaagtcatccgtctgtcagaatggtcgagactatgttgtggc
caagcagccatccgtctgtccgtgttccctggaggacttcctctgtgactttggctacttccgtccggagaacgcctcagagtgcgtgga
gcagcctgaactgaaggggcatgagttagagtctgtctgtacggcaaggaggagcacctgacaacaaatgggtaccggaaaatccc
aggagacaaatgccaaggtgggatgaatcccgccagagaagtaaaagacttgaaaaagaaatgcacaagcaacttcttgaaccccac
aaagcaggactcccgcccacagggacacagcttgtcccagaatccagctccgcctcctcttggatacactgaaaacacacacttcctat
ctcctacccagaagcagaattccaagtcaaattctgtccctattatcctggccatcgtgggactgatgcttgtcacagtcgtagcaggagt
cctcattgtgaagaaatatgtctgtggcggaaggttcctggtgcaccggtactcggtgctacagcagcacgcagaggctgacggcgta
gaggcttttggattcaacctcccacgctaaaagcggatatcacgacgactcagatgaggacctcctggaatag Sortilin Human (nucleic acid sequence):

(SEQ ID NO: 80)
Atggagcggccctggggagctgcggacggcctctcgcgctggcccccatggcctcggcctcctcctcctgcagctgctgccgcc
gtcgaccctcagccaggaccggctggacgcgccgccgccgccgcgctgcgccgctgccgcgctggtctggccccatcggggtgagc -continued tgggggctgcgggcggccgcagccggggggcgcgtttccccgcggcggccgttgg<u>cgtcgc</u>agcgcgccgggcgaggacgagga
gtgcggccgggtccgggacttcgtcgccaagctggccaacaacacgcaccagcatgtgtttgatgatctcagagctcagtatccttgt
cctgggttggagatagcactggggtcattctagtcttgactaccttccatgtaccactggtaattatgacttttggacagtccaagctatatc
gaagtgaggattatgggaagaactttaaggatattacagatctcatcaataacacctttattcggactgaatttggcatggctattggtcctg
agaactctggaaaggtggtgttaacagcagaggtgtctggaggaagtcgtggaggaagaatctttagatcatcagattttgcgaagaatt
ttgtgcaaacagatctcccttttcatcctctcactcagatgatgtatagccctcagaattctgattatcttttagctctcagcactgaaaatggc
ctgtgggtgtccaagaattttgggggaaaatgggaagaaatccacaaagcagtatgtttggcccaaatggggatcagacaacaccatctt
ctttacaacctatgcaaatggctcctgcaaagctgaccttggggctctggaattatggagaacttcagacttgggaaaaagcttcaaaact
attggtgtgaaaatctactcatttggtcttggggggacgtttccttttttgcctctgtgatggctgataaggatacaacaagaaggatccacgttt
caacagatcaaggggacacatggagcatggcccagctcccctccgtgggacaggaacagttctattctattctggcagcaaatgatga
catggtattcatgcatgtagatgaacctggagacactgggtttggcacaatctttacctcagatgatcgaggcattgtctattccaagtcttt
ggaccgacatctctacactaccacaggcggagagacggacttaccaacgtgacctccctccgcggcgtctacataacaagcgtgctc
tccgaagataattctatccagaccatgatcacttttgaccaaggaggaaggtggacgcacctgaggaagcctgaaaacagtgaatgtga
tgctacagcaaaaaacaagaatgagtgcagccttcatattcatgcttcctacagcatctcccagaaactgaatgttccaatggcccactc
tcagagccgaatgccgtaggcattgtcattgctcatggtagcgtgggggatgccatctcagtgatggttccagatgtgtacatctcagatg
atgggggttactcctggacaaagatgctggaaggaccccactattacaccatcctggattctggaggcatcattgtggccattgagcaca
gcagccgtcctatcaatgtgattaagttctccacagacgaaggtcaatgctggcaaacctacacgttcaccagggacccccatctatttcac
tggcctagcttcagaacctggagctaggtccatgaatatcagcatttggggcttcacagaatctttcctgaccagccagtgggtctcctac
accattgattttaaagatatccttgaaaggaactgtgaagagaaggactataccatggctggcacactccacagaccctgaagattatg
aagatggctgcattttgggctacaaagaacagtttctgcggctacgcaagtcatccgtgtgtcagaatggtcgagactatgttgtgaccaa
gcagccctccatctgcctctgttcctggaggactttctctgtgattttggctactaccgtccagaaaatgactccaagtgtgtggaacagc
cagaactgaagggccacgacctggagttttgtctgtacggaagagaagaacacctaacaacaaatgggtaccggaaaattccagggg
acaaatgccagggtggggtaaatccagttcgagaagtaaaagacttgaaaaagaaatgcacaagcaacttttttgagtccggaaaaaca
gaattccaagtcaaattctgttccaattatcctggccatcgtgggattgatgctggtcacagtcgtagcaggagtgctcattgtgaagaaat
atgtctgtggggaaggttcctggtgcatcgatactctgtgctgcagcagcatgcagaggccaatggtgtggatggtgtggatgctttgg
acacagcctcccacactaataaaagtggttatcatgatgactcagatgaggacctcttggaatag Neuropeptide W Mouse (nucleic acid sequence):

(SEQ ID NO: 81)

Ctggcgtctaacagagaagtgcggggccctgggcccgggactcccaggaaccggcccctgctgcccctgctgctgcactgctcttg
ctaccgctgcccgccagcgcctggtataagcacgtggcgagtccccgctatcacacagtgggtcgtgcctccgggctgctcatgggg
ctgcgccgctcgccctaccagtgg<u>cgccgt</u>gccctgggcggggctgctggaccctctcccggctcccaggaccggtcgcccgcgg
cgctctcctgcttccttcctcagggcaggagctgtgggaggtacgaagcaggagctcacctgcagggcttcccgtccatgcaccctgg
agtccgcgggacctggagggagtccgccaaccggagcagtcgctaagccttcactcctggatctcagaggagcccgctgctagagc
cttcggagagacgcttcgtgcccagccatggttcctgcagcaagtcatctttgccgatcctgtcaggcccaagaaccgatggcgcccc
atgcttga Neuropeptide W Human (nucleic acid sequence):

(SEQ ID NO: 82)

Ctggcgtggcgcccaggggagcgggggctcccgcgagccggccgcggctggcactgctgctgcttctgctcctgctgccgctgc
cctccggcgcgtggtacaagcacgtggcgagtccccgctaccacacggtgggccgcgccgctggcctgctcatggggctgcgtcgc
tcaccctatctgtgg<u>cgccgc</u>gcgctgcgcgcggccgccgggcccctggccagggacacccctctcccccgaacccgcagcccgcg
aggtcctctcctgctgccctcgtgggttcaggagctgtgggagacgcgacgcaggagctcccaggcagggatcccgtccgtgcgc
cccggagcccgcgcgccccagagcctgcgctggaaccggagtccctggacttcagcggagctggccagagacttcggagagacgt
ctcccgcccagcggtggaccccgcagcaaaccgccttggcctgccctgcctggccccggaccgttctga -continued CART Mouse (nucleic acid sequence):
(SEQ ID NO: 83)
Atggagagctcccgcctgcggctgctacccctcctgggcgccgccctgctgctactgctaccttt gctgggtgcccgtgcccaggagg acgccgagctgcagccccgagccctggacatctactctgccgtggatgatgcgtcccacgagaaggagctgatcgaagcgttgcaag aagtcctgaagaagctcaagagtaaacgcattccgatctacgagaagaagtacggccaagtccccatgtgtgacgctggagagcagt gcgcagtgaggaaaggggccaggatcgggaagctgtgtgactgtccccgaggaacttcctgcaattcttt cctcttgaagtgcttgtga CART Human (nucleic acid sequence):
(SEQ ID NO: 84)
Atggagagctcccgcgtgaggctgctgccccctcctgggcgccgccctgctgctgatgctacctctgttgggtacccgtgcccaggag gacgccgagctccagccccgagccctggacatctactctgccgtggatgatgcctcccacgagaaggagctgatcgaagcgctgcaa gaagtcttgaagaagctcaagagtaaacgtgttcccatctatgagaagaagtatggccaagtccccatgtgtgacgccggtgagcagtg tgcagtgaggaaaggggcaaggatcgggaagctgtgtgactgtccccgaggaacctcctgcaattccttcctcctgaagtgcttatga TGFB1 Mouse (nucleic acid sequence):
(SEQ ID NO: 85)
Atgccgccctcggggctgcggctactgccgcttctgctcccactcccgtggcttctagtgctgacgcccggggaggccagccgcggga ctctccacctgcaagaccatcgacatggagctggtgaaacggaagcgcatcgaagccatccgtggccagatcctgtccaaactaagg ctcgccagtcccccaagccaggggaggtaccgcccggcccgctgcccgaggcggtgctcgctttgtacaacagcacccgcgacc gggtggcaggcgagagcgccgacccagagccggagcccgaagcggactactatgctaaagaggtcacccgcgtgctaatggtgga ccgcaacaacgccatctatgagaaaaccaaagacatctcacacagtatatatatgttcttcaatacgtcagacattcggggaagcagtgcc cgaaccccccattgctgtcccgtgcagagctgcgcttgcagagattaaaatcaagtgtggagcaacatgtggaactctaccagaaatata gcaacaattcctggcgttaccttggtaaccggctgctgaccccccactgatacgcctgagtggctgtcttttgacgtcactggagttgtacg gcagtggctgaaccaaggagacggaatacagggctttcgattcagcgctcactgctcttgtgacagcaaagataacaaactccacgtg gaaatcaacgggatcagccccaaacgtcggggcgacctgggcaccatccatgacatgaaccggcccttcctgctcctcatggccacc cccctggaaagggcccagcacctgcacagctcacggcac cggagagccctggataccaactattgcttcagctccacagagaagaa ctgctgtgtgcggcagctgtacattgactttaggaaggacctgggttggaagtggatccacgagcccaagggctaccatgccaacttct gtctgggaccctgcccctatatttggagcctggacacacagtacagcaaggtccttgccctctacaaccaacacaacccgggcgcttcg gcgtcaccgtgctgcgtgccgcaggctttggagccactgcccatcgtctactacgtgggtcgcaagcccaaggtggagcagttgtcca acatgattgtgcgctcctgcaagtgcagctga TGFB1 Human (nucleic acid sequence):
(SEQ ID NO: 86)
Atgccgccctccggggctgcggctgctgccgctgctgctaccgctgctgtggctactggtgctgacgcctggccggccggccgcggg actatccacctgcaagactatcgacatggagctggtgaagcggaagcgcatcgaggccatccgcggccagatcctgtccaagctgcg gctcgccagcccccgagccaggggaggtgccgccggccgctgcccgaggccgtgctcgccctgtacaacagcacccgcga ccgggtggccggggagagtgcagaaccggagcccgagcctgaggccgactactacgccaaggaggtcacccgcgtgctaatggtg gaaacccacaacgaaatctatgacaagttcaagcagagtacacacagcatatatatgttcttcaacacatcagagctccgagaagcggt acctgaacccgtgttgctctcccgggcagagctgcgtctgctgaggctcaagttaaaagtggagcagcacgtggagctgtaccagaaa tacagcaacaattcctggcgatacctcagcaaccggctgctggcacccagcgactcgccagagtggttatcttttgatgtcaccggagtt gtgcggcagtggttgagccgtggaggggaaattgagggctttcgccttagcgcccactgctcctgtgacagcagggataacacactgc aagtggacatcaacgggttcactaccggccgccgaggtgacctggccaccattcatggcatgaaccggccttt cctgcttctcatggcc accccgctggagagggcccagcatctgcaaagctcccggcac cgccgag ccctggacaccaactattgcttcagctccacggagaa gaactgctgcgtgcggcagctgtacattgacttccgcaaggacctcggctggaagtggatccacgagcccaagggctaccatgccaa cttctgcctcgggccctgccccctacatttggagcctggacacgcagtacagcaaggtcctggccctgtacaaccagcataacccgggc gcctcggcggcgcgtgctgcgtgccgcaggcgctggagccgctgcccatcgtgtactacgtgggccgcaagcccaaggtggagc agctgtccaacatgatcgtgcgctcctgcaagtgcagctga -continued TGFB2 Mouse (nucleic acid sequence):

(SEQ ID NO: 87)

Atgcactactgtgtgctgagcacctttttgctcctgcatctggtcccggtggcgctcagtctgtctacctgcagcaccctcgacatggatc agtttatgcgcaagaggatcgaggccatccgcgggcagatcctgagcaagctgaagctcaccagcccccggaagactatccggag ccggatgaggtccccccggaggtgatttccatctacaacagtaccagggacttactgcaggagaaggcaagccggagggcagccgc ctgcgagcgcgagcggagcgacgaggagtactacgccaaggaggtttataaaatcgacatgccgtcccacctcccctccgaaaatgc catcccgcccactttctacagaccctacttcagaatcgtccgctttgatgtctcaacaatggagaaaaatgcttcgaatctggtgaaggca gagttcagggtcttccgcttgcaaaaccccaaagccagagtggccgagcagcggattgaactgtatcagatccttaaatccaaagactt aacatctcccacccagcgctacatcgatagcaaggttgtgaaaaccagagcggaggtgaatggctctccttcgacgtgacagacgct gtgcaggagtggcttcaccacaaagacaggaacctggggtttaaaataagtttacactgcccctgctgtaccttcgtgccgtctaataatt acatcatcccgaataaaagcgaagagctcgaggcgagatttgcaggtattgatggcacctctacatatgccagtggtgatcagaaaact ataaagtccactaggaaaaaaaaccagtgggaagaccccacatctcctgctaatgttgttgccctcctacagactggagtcacaacagtcc agccggcggaagaagcgcgctttggatgctgcctactgctttagaaatgtgcaggataattgctgccttcgccctcttttacattgattttaa gagggatcttggatggaaatggatccatgaacccaaagggtacaatgctaacttctgtgctggggcatgcccatatctatggagttcaga cactcaacacaccaaagtcctcagcctgtacaacaccataaatcccgaagcttccgcttcccccttgctgtgtgtcccaggatctggaacc actgaccattctctattacattggaaatacgcccaagatcgaacagctttccaatatgattgtcaagtcttgtaaatgcagctaa TGFB2 Human (nucleic acid sequence):

(SEQ ID NO: 88)

Atgcactactgtgtgctgagcgcttttctgatcctgcatctggtcacggtcgcgctcagcctgtctacctgcagcacactcgatatggacc agttcatgcgcaagaggatcgaggcgatccgcgggcagatcctgagcaagctgaagctcaccagtccccagaagactatcctgagc ccgaggaagtccccccggaggtgatttccatctacaacagcaccaggg acttgctccaggagaaggcgagccggagggcggccgc ctgcgagcgcgagaggagcgacgaagagtactacgccaaggaggtttacaaaatagacatgccgcccttcttcccctccgaaactgtc tgcccagttgttacaacaccctctggctcagtgggcagcttgtgctccagacagtcccaggtgctctgtgggtaccttgatgccatcccgc ccactttctacagaccctacttcagaattgttcgatttgacgtctcagcaatggagaagaatgcttccaatttggtgaaagcagagttcaga gtctttcgtttgcagaacccaaaagccagagtgcctgaacaacggattgagctatatcagattctcaagtccaaagatttaacatctccaac ccagcgctacatcgacagcaaagttgtgaaaacaagagcagaaggcgaatggctctccttcgatgtaactgatgctgttcatgaatggct tcaccataagacaggaacctgggatttaaaataagcttacactgtccctgctgcacttttgtaccatctaataattacatcatcccaaataa aagtgaagaactagaagcaagatttgcaggtattgatggcacctccacatataccagtggtgatcagaaaactataaagtccactaggaa aaaaaacagtgggaagaccccacatctcctgctaatgttattgccctcctacagacttgagtcacaacagaccaaccggcggaagaag cgtgctttggatgcggcctattgctttagaaatgtgcaggataattgctgcctacgtccactttacattgatttcaagagggatctagggtgg aaatggatacacgaacccaaagggtacaatgccaacttctgtgctggagcatgcccgtatttatggagttcagacactcagcacagcag ggtcctgagcttatataataccataaatccagaagcatctgcttctccttgctgcgtgtcccaagatttagaacctctaaccattctctactac attggcaaaacacccaagattgaacagctttctaatatgattgtaaagtcttgcaaatgcagctaa TGFB3 Mouse (nucleic acid sequence):

(SEQ ID NO: 89)

Atgaagatgcacttgcaaagggctctggtagtcctggccctgctgaacttggccacaatcagcctctctctgtccacttgcaccacgttg gacttcggccacatcaagaagaagagggtggaagccattaggggacagatcttgagcaagctcaggctcaccagcccccctgagcc atcggtgatgacccacgtcccctatcaggtcctggcactttacaacagcacccgggagttgctggaagagatgcacgggagaggga ggaaggctgcactcaggagacctcggagtctgagtactatgccaaagagatccataaattcgacatgatccaggactggcggagcag caatgaactggccgtctgccccaaggaattacctctaaggttttttcgtttcaatgtgtcctcagtggagaaaaatggaaccaatctgttcc gggcagagttccgggtcttgcgggtgcccaaccccagctccaagcgcacagagcagaaattgagctcttccagatacttcgaccgg atgagcacatagccaagcagcgctacataggtggcaagaatctgcccacaaggggcaccgctgaatggctgtctttcgatgtcactga cactgtgcgcgagtggctgttgaggagagagtccaacttgggtctggaaatcagcatccactgtccatgtcacacctttcagcccaatgg agacatactggaaaatgttcatgaggtgatggaaatcaaattcaaaggagtggacaatgaagatgaccatggccgtggagacctgggg -continued cgtctcaagaagcaaaaggatcaccacaacccacacctgatcctcatgatgatcccccacaccgactggacagcccaggccagggc agtcag<u>aggaag</u>aagagggccctggacaccaattactgcttccgcaacctggaggagaactgctgtgtacgccccttatattgacttc cggcaggatctaggctggaaatgggtccacgaacctaagggttactatgccaacttctgctcaggcccttgcccatacctccgcagcgc agacacaacccatagcacggtgcttggactatacaacaccctgaacccagaggcgtctgcctcgccatgctgcgtccccaggacctg gagcccctgaccatcttgtactatgtgggcagaaccccccaaggtggagcagctgtccaacatggtggtgaagtcgtgtaagtgcagctg a TGFB3 Human (nucleic acid sequence):

(SEQ ID NO: 90)

Atgaagatgcacttgcaaagggctctggtggtcctggccctgctgaactttgccacggtcagcctctctctgtccacttgcaccaccttg gacttcggccacatcaagaagaagagggtggaagccattaggggacagatcttgagcaagctcaggctcaccagccccctgagcc aacggtgatgacccacgtccctatcaggtcctggcccttacaacagcacccgggagctgctggaggagatgcatggggagaggga ggaagcctgcacccaggaaaacaccgagtcggaatactatgccaaagaaatccataaattcgacatgatccaggggctggcggagc acaacgaactggctgtctgccctaaaggaattacctccaaggttttccgcttcaatgtgtcctcagtggagaaaaatagaaccaacctatt ccgagcagaattccgggtcttgcgggtgcccaaccccagctctaagcggaatgagcagaggatcgagctcttccagatccttcggcca gatgagcacattgccaaacagcgctatatcggtggcaagaatctgcccacacggggcactgccgagtggctgtcctttgatgtcactga cactgtgcgtgagtggctgttgagaagagagtccaacttaggtctagaaatcagcattcactgtccatgtcacacctttcagcccaatgga gatatcctggaaaacattcacgaggtgatggaaatcaaattcaaaggcgtggacaatgaggatgaccatggccgtggagatctgggc gcctcaagaagcagaaggatcaccacaaccctcatctaatcctcatgatgattcccccacaccggctcgacaacccgggccaggggg gtcag<u>aggaag</u>aagcgggctttggacaccaattactgcttccgcaacttggaggagaactgctgtgtgcgccccctctacattgacttcc gacaggatctgggctggaagtgggtccatgaacctaagggctactatgccaacttctgctcaggcccttgcccatacctccgcagtgca gacacaacccacagcacggtgctggactgtacaacactctgaaccctgaagcatctgcctcgccttgctgcgtgccccaggacctgg agcccctgaccatcctgtactatgttggggaggaccccccaaagtggagcagctctccaacatggtggtgaagtcttgtaaatgtagctga PDGF alpha Mouse (nucleic acid sequence):

(SEQ ID NO: 91)

Atgaggacctgggcttgcctgctgctcctcggctgcggataccctcgcccatgccctggccgaggaagccgagataccccgggagttg atcgagcggctggctcgaagtcagatccacagcatccgggacctccagcgactcttggagatagactccgtaggggctgaggatgcc ttggagacaagtctgagagcccatgggtcccatgccattaaccatgtgcccgagaagcggcctgtgcccatt<u>cgcagg</u>aagagaagta ttgaggaagccattcctgcagtttgcaagaccaggacggtcatttacgagatacctcggagccaggtggaccccacatcggccaacttc ctgatctggccccatgtgtggaggtgaagcgctgcactggctgttgtaacaccagcagcgtcaagtgccaagccttcacgggtccacc accgcagtgtcaaggtggccaaagtggagtatgtcaggaagaagccaaaattgaaagaggtccaggtgaggttagaggaacacctg gagtgtgcatgtgcgacctccaacctgaacccagaccatcgggaggaggagacagatgtgaggtga PDGF alpha Human (nucleic acid sequence):

(SEQ ID NO: 92)

Atgaggaccttggcttgcctgctgctcctcggctgcggataccctcgcccatgttctggccgaggaagccgagatcccccgcgaggtga tcgagaggctggcccgcagtcagatcccagcatccgggacctccagcgactcctggagatagactccgtagggagtgaggattcttt ggacaccagcctgagagctcacggggtccatgccactaagcatgtgcccgagaagcggccctgcccatt<u>cggagg</u>aagagaagc atcgaggaagctgtccccgctgtctgcaagaccaggacggtcatttacgagattcctcggagtcaggtcgaccccacgtccgccaactt cctgatctggccccgtgcgtggaggtgaaacgctgcaccggctgctgcaacacgagcagtgtcaagtgccagcccctcccgcgtcca ccaccgcagcgtcaaggtggccaaggtggaatacgtcaggaagaagccaaaattaaaagaagtccaggtgaggttagaggagcattt ggagtgcgcctgcgcgaccacaagcctgaatccggattatcgggaagaggacacgggaaggcctagggagtcaggtaaaaaacgg aaaagaaaaaggttaaaacccacctaa Brain derived neurotrophic factor (BDNF) Mouse (nucleic acid sequence):

(SEQ ID NO: 93)

Atgttccaccaggtgagaagagtgatgaccatccttttccttactatggttatttcatacttcggttgcatgaaggcggcgcccatgaaaga agtaaacgtccacggacaaggcaacttggcctacccaggtgtgcggacccatgggactctggagagcgtgaatgggcccagggcag gttcgagaggtctgacgacgacatcactggctgacacttttgagcacgtcatcgaagagctgctggatgaggaccagaaggttcggcc caacgaagaaaaccataaggacgcggacttgtacacttcccggggtgatgctcagcagtcaagtgcctttggagcctcctctactctttctg ctggaggaatacaaaaattacctggatgccgcaaacatgtctatgagggtt<u>cggcgc</u>cactccgaccctgcccgccgtggggagctga gcgtgtgtgacagtattagcgagtgggtcacagcggcagataaaaagactgcagtggacatgtctggcgggacggtcacagtcctag agaaagtcccggtatccaaaggccaactgaagcagtatttctacgagaccaagtgtaatcccatggggttacaccaaggaaggctgcag gggcatagacaaaaggcactggaactcgcaatgccgaactacccaatcgtatgttcgggcccttactatggatagcaaaaagagaattg gctggcgattcataaggatagacacttcctgtgtatgtacactgaccattaaaaggggaagatag Brain derived neurotrophic factor (BDNF) Human (nucleic acid sequence):

(SEQ ID NO: 94)

Atgaccatcctttttccttactatggttatttcatactttggttgcatgaaggctgcccccatgaaagaagcaaacatccgaggacaaggtgg cttggcctacccaggtgtgcggacccatgggactctggagagcgtgaatgggcccaaggcaggttcaagaggcttgacatcattggct gacactttcgaacacgtgatagaagagctgttggatgaggaccagaaagttcggcccaatgaagaaaacaataaggacgcagacttgt acacgtccagggtgatgctcagtagtcaagtgcctttggagcctcctcttctctttctgctggaggaatacaaaaattacctagatgctgca aacatgtccatgagggtccggcgccactctgaccctgcc<u>cgccga</u>ggggagctgagcgtgtgtgacagtattagtgagtgggtaacg gcggcagacaaaaagactgcagtggacatgtcgggcgggacggtcacagtccttgaaaaggtccctgtatcaaaaggccaactgaa gcaatacttctacgagaccaagtgcaatcccatggttacacaaaagaaggctgcaggggcatagacaaaaggcattggaactccca gtgccgaactacccagtcgtacgtgcgggcccttaccatggatagcaaaaagagaattggctggcgattcataaggatagacacttctt gtgtatgtacattgaccattaaaaggggaagatag Beta nerve growth factor Mouse (nucleic acid sequence):

(SEQ ID NO: 95)

Atgtccatgttgttctacactctgatcactgcgttttttgatcggcgtacaggcagaaccgtacacagatagcaatgtcccagaaggagact ctgtccctgaagcccactggactaaacttcagcattcccttgacacagccctccgcagagcccgcagtgcccctactgcaccaatagct gcccgagtgacagggcagacccgcaacatcactgtagaccccagactgtttaagaaacggagactccactcaccccgtgtgctgttca gcacccagcctccacccacctcttcagacactctggatctagacttccaggcccatggtacaatccccttcaacaggactcaccggagc <u>aagcgc</u>tcatccacccacccagtcttccacatgggggagttctcagtgtgtgacagtgtcagtgtgtgggttggagataagaccacagc cacagacatcaagggcaaggaggtgacagtgctggccgaggtgaacattaacaacagtgtattcagacagtactttttttgagaccaagt gccgagcctccaatcctgttgagagtgggtgccggggcatcgactccaaacactggaactcatactgcaccacgactcacaccttcgtc aaggcgttgacaacagatgagaagcaggctgcctggaggttcatccggatagacacagcctgtgtgtgtgtgctcagcaggaaggcta caagaagaggctga Beta nerve growth factor Human (nucleic acid sequence):

(SEQ ID NO: 96)

Atgtccatgttgttctacactctgatcacagcttttctgatcggcatacaggcggaaccacactcagagagcaatgtccctgcaggacac accatcccccaagcccactggactaaacttcagcattcccttgacactgcccttcgcagagcccgcagcgccccggcagcggcgata gctgcacgcgtggcggggcagacccgcaacattactgtggaccccaggctgtttaaaaagcggcgactccgttcaccccgtgtgctgt ttagcacccagcctccccgtgaagctgcagacactcaggatctggacttcgaggtcggtggtgctgcccccttcaacaggactcacag gagc<u>aagcggt</u>catcatcccatcccatcttccacaggggcgaattctcggtgtgtgacagtgtcgcgtgtgggttggggataagacca ccgccacagacatcaagggcaaggaggtgatggtgttgggagaggtgaacattaacaacagtgtattcaaacagtacttttttgagacc aagtgccggacccaaatcccgttgacagcgggtgccggggcattgactcaaagcactggaactcatattgtaccacgactcacaccttt tgtcaaggcgctgaccatggatggcaagcaggctgcctggcggtttatccggatagatacggcctgtgtgtgtgtgctcagcaggaag gctgtgagaagagcctga Albumin Mouse (nucleic acid sequence):

(SEQ ID NO: 97)

Atgaagtgggtaaccttttctcctcctcctcttcgtctccggctctgcttttttccaggggtgtgttt<u>cgccga</u>gaagcacacaagagtgagat cgcccatcggtataatgatttgggagaacaacatttcaaaggcctagtcctgattgccttttcccagtatctccagaaatgctcatacgatg -continued agcatgccaaattagtgcaggaagtaacagactttgcaaagacgtgtgttgccgatgagtctgccgccaactgtgacaaatcccttcaca
ctcttttttggagataagttgtgtgccattccaaacctccgtgaaaactatggtgaactggctgactgctgtacaaaacaagagcccgaaag
aaacgaatgtttcctgcaacacaaagatgacaaccccagcctgccaccatttgaaaggccagaggctgaggccatgtgcacctccttta
aggaaaacccaaccacctttatgggacactatttgcatgaagttgccagaagacatccttatttctatgccccagaacttctttactatgctg
agcagtacaatgagattctgacccagtgttgtgcagaggctgacaaggaaagctgcctgaccccgaagcttgatggtgtgaaggagaa
agcattggtctcatctgtccgtcagagaatgaagtgctccagtatgcagaagtttggagagagagcttttaaagcatgggcagtagctcgt
ctgagccagacattccccaatgctgactttgcagaaatcaccaaattggcaacagacctgaccaaagtcaacaaggagtgctgccatgg
tgacctgctggaatgcgcagatgacagggcggaacttgccaagtacatgtgtgaaaaccaggcgactatctccagcaaactgcagact
tgctgcgataaaccactgttgaagaaagcccactgtcttagtgaggtggagcatgacaccatgcctgctgatctgcctgccattgctgctg
attttgttgaggaccaggaagtgtgcaagaactatgctgaggccaaggatgtcttcctgggcacgttcttgtatgaatattcaagaagaca
ccctgattactctgtatccctgttgctgagacttgctaagaaatatgaagccactctggaaaagtgctgcgctgaagccaatcctcccgcat
gctacggcacagtgcttgctgaatttcagcctcttgtagaagagcctaagaacttggtcaaaaccaactgtgatctttacgagaagcttgg
agaatatggattccaaaatgccattctagttcgctacacccagaaagcacctcaggtgtcaaccccaactctcgtggaggctgcaagaa
acctaggaagagtgggcaccaagtgttgtacacttcctgaagatcagagactgccttgtgtggaagactatctgtctgcaatcctgaacc
gtgtgtgtctgctgcatgagaagacccccagtgagtgagcatgttaccaagtgctgtagtggatccctggtggaaaggcggccatgcttct
ctgctctgacagttgatgaaacatatgtccccaaagagtttaaagctgagaccttcaccttccactctgatatctgcacacttccagagaag
gagaagcagattaagaaacaaacggctcttgctgagctggtgaagcacaagcccaaggctacagcggagcaactgaagactgtcatg
gatgactttgcacagttcctggatacatgttgcaaggctgctgacaaggacacctgcttctcgactgagggtccaaaccttgtcactagat
gcaaagacgccttagcctaa Albumin Human (nucleic acid sequence):

(SEQ ID NO: 98)

atgaagtgggtaacctttatttcccttcttttttctctttagctcggcttattccaggggtgtgtttcgtcgagatgcacacaagagtgaggttgc
tcatcggtttaaagatttgggagaagaaaatttcaaagccttggtgttgattgcctttgctcagtatcttcagcagtgtccatttgaagatcatg
taaaattagtgaatgaagtaactgaatttgcaaaaacatgtgttgctgatgagtcagctgaaaattgtgacaaatcacttcatacccttttgg
agacaaaattatgcacagttgcaactcttcgtgaaacctatggtgaaatggctgactgctgtgcaaaacaagaacctgagagaaatgaatg
cttcttgcaacacaaagatgacaacccaaacctcccccgattggtgagaccagaggttgatgtgatgtgcactgcttttcatgacaatgaa
gagacatttttgaaaaaatacttatatgaaattgccagaagacatccttacttttatgccccggaactccttttctttgctaaaaggtataaagc
tgcttttacagaatgttgccaagctgctgataaagctgcctgcctgttgccaaagctcgatgaacttcgggatgaagggaaggcttcgtct
gccaaacagagactcaagtgtgccagtctccaaaaatttggagaaagagctttcaaagcatgggcagtagctcgcctgagccagag at
ttcccaaagctgagtttgcagaagtttccaagttagtgacagatcttaccaaagtccacacggaatgctgccatggagatctgcttgaatgt
gctgatgacagggcggaccttgccaagtatatctgtgaaaatcaagattcgatctccagtaaactgaaggaatgctgtgaaaaacctctg
ttggaaaaatcccactgcattgccgaagtggaaaatgatgagatgcctgctgacttgccttcattagctgctgattttgttgaaagtaaggat
gtttgcaaaaactatgctgaggcaaaggatgtcttcctgggcatgttttttgtatgaatatgcaagaaggcatcctgattactctgtcgtgctg
ctgctgagacttgccaagacatatgaaaccactctagagaagtgctgtgccgctgcagatcctcatgaatgctatgccaaagtgttcgat
gaatttaaacctcttgtggaagagcctcagaatttaatcaaacaaaattgtgagctttttgagcagcttggagagtacaaattccagaatgc
gctattagttcgttacaccaagaaagtaccccaagtgtcaactccaactcttgtagaggtctcaagaaacctaggaaaagtgggcagcaa
atgttgtaaacatcctgaagcaaaaagaatgccctgtgcagaagactatctatccgtggtcctgaaccagttatgtgtgttgcatgagaaa
acgccagtaagtgacagagtcaccaaatgctgcacagaatccttggtgaacaggcgaccatgcttttcagctctggaagtcgatgaaac
atacgttcccaaagagtttaatgctgaaacattcaccttccatgcagatatatgcacactttctgagaaggagagacaaatcaagaaacaa
actgcacttgttgagctcgtgaaacacaagcccaaggcaacaaaagagcaactgaaagctgttatggatgatttcgcagcttttgtagag
aagtgctgcaaggctgacgataaggagacctgctttgccgaggagggtaaaaaacttgttgctgcaagtcaagctgccttaggcttataa Calcitonin Mouse (nucleic acid sequence):

(SEQ ID NO: 99)

Atgggcttcctgaagttctccccttcctggttgtcagcatcttgctcctgtaccaggcatgcagcctccaggcagtgcctttgaggtcaat cttggaaagcagcccaggcatggccactctcagtgaagaagaagttcgcctgctggctgcactggtgcaggactatatgcagatgaaa gccagggagctggagcaggaggaagagcaggaggctgagggctctagcttggacagcccagatctaagcggtgtgggaatctga gtacctgcatgctgggcacgtacacacaagacctcaacaagtttcacaccttcccccaaacttcaattggggttgaagcacctggcaag aaaagggatgtggccaaggacttggagacaaaccaccaatcccattttggcaactaa Calcitonin Human (nucleic acid sequence):

(SEQ ID NO: 100)

Atgggcttccaaaagttctcccccttcctggctctcagcatcttggtcctgttgcaggcaggcagcctccatgcagcaccattcaggtctg ccctggagagcagcccagcagacccggccacgctcagtgaggacgaagcgcgcctcctgctggctgcactggtgcaggactatgtg cagatgaaggccagtgagctggagcaggagcaagagagagagggctccagcctggacagcccagatctaagcggtgcggtaatc tgagtacttgcatgctgggcacatacacgcaggacttcaacaagtttcacacgttcccccaaactgcaattggggttggagcacctggaa agaaaagggatatgtccagcgacttggagagagaccatcgccctcatgttagcatgcccagaatgccaactaa Exemplary cleavage sites that can be used for the constructs of the present invention include, but are not limited to, aagagg (SEQ ID NO: 101); aagcgt (SEQ ID NO: 102); aagcgc (SEQ ID NO: 103); aaaaga (SEQ ID NO: 104); aagaggagg (SEQ ID NO: 105); aagaga (SEQ ID NO: 106); cgcaaa (SEQ ID NO: 107); cggcgg (SEQ ID NO: 108); tatctg (SEQ ID NO: 109); aggcgg (SEQ ID NO: 110); cggagc (SEQ ID NO: 111); cggtct (SEQ ID NO: 112); cgaagc (SEQ ID NO: 113); aaacgg (SEQ ID NO: 114); aagagaggt (SEQ ID NO: 115); aaacgaggc (SEQ ID NO: 116); gggccgccgc (SEQ ID NO: 117); ccacgagct (SEQ ID NO: 118); ccccgagct (SEQ ID NO: 119); cgaaggcagct-gcgggct (SEQ ID NO: 120); cgtaggcagctgagggta (SEQ ID NO: 121); cgccgcagt (SEQ ID NO: 122); cgaaga (SEQ ID NO: 123); cggaga (SEQ ID NO: 124); agaagg (SEQ ID NO: 125); aaacgc (SEQ ID NO: 126); tccagcattcggagg (SEQ ID NO: 127); agcagtcggagg (SEQ ID NO: 128); gagagggac (SEQ ID NO: 129); cggcgc (SEQ ID NO: 130); aggcgc (SEQ ID NO: 131); cggggcaccaag (SEQ ID NO: 132); caccgc (SEQ ID NO: 133); acccgtgtc (SEQ ID NO: 134); tcgcgcatt (SEQ ID NO: 135); cgacgg (SEQ ID NO: 136); aagagaaga (SEQ ID NO: 137); and ggccgccgc (SEQ ID NO: 138).

One skilled in the art would know how to design a cleavage site, so the propeptide and bioluminescent protein will separate and function normally.

Any luciferase known in the art, any propeptide known in the art and any cleavage site known in the art can be used to make a fusion protein according to the method of the present invention.

Exemplary luciferase fusion proteins (their nucleic acid sequences) include, but are not limited to, the sequences below. Underline indicates the putative cleavage sites. Italics indicates *Gaussia* luciferase without its signal peptide.

Proamylin Mouse (nucleic acid sequence):

(SEQ ID NO: 139)

Atgatgtgcatctccaaactgccagctgtcctcctcctctctgtggc
actgaaccacttgagagctacacctgtcagaagttggtagcaaccctcaga
tggacaaacggaagtgcaacacggccacgtgtgccacacaacgcctggca
aacttttggttcgttccagcaacaaccttggtccagtcctcccaccaac
caacgtgggatcgaatacatatggc*aagagg*aatgcgaagcccaccgaga
*acaacgaagacttcaacatcgtggccgtggccagcaacttcgcgaccacg
gatctcgatgctgaccgcgggaagttgcccggcaagaagctgccgctgga
ggtgctcaaagagatggaagccaatgcccggaaagctggctgcaccaggg
gctgtctgatctgcctgtcccacatcaagtgcacgcccaagatgaagaag* ttcatcccaggacgctgccacacctacgaaggcgacaaagagtccgcaca
gggcggcataggcgaggcgatcgtcgacattcctgagattcctgggttca
aggacttggagcccatggagcagttcatcgcacaggtcgatctgtgtgtg
gactgcacaactggctgcctcaaagggcttgccaacgtgcagtgttctga
cctgctcaagaagtggctgccgcaacgctgtgcgaccctttgccagcaaga
tccagggccaggtggacaagatcaaggggggccggtggtgacaagaggaat
gcggcaggggatccaaatagggaatccttggatttcttactcgtttaa Proamylin Human (nucleic acid sequence):

(SEQ ID NO: 140)

Atgggcatcctgaagctgcaagtatttctcattgtgctctctgttgcatt
gaaccatctgaaagctacacccattgaaagtcatcaggtggaaaagcgga
aatgcaacactgccacatgtgcaacgcagcgcctggcaaattttttagtt
cattccagcaacaacttttggtgccattctctcatctaccaacgtgggatc
caatacatatggc*aagagg*aatgcaaagcccaccgagaacaacgaagact
tcaacatcgtggccgtggccagcaacttcgcgaccacggatctcgatgct
gaccgcgggaagttgcccggcaagaagctgccgctggaggtgctcaaaga
gatggaagccaatgcccggaaagctggctgcaccaggggctgtctgatct
gcctgtcccacatcaagtgcacgcccaagatgaagaagttcatcccagga
cgctgccacacctacgaaggcgacaaagagtccgcacagggcggcatagg
cgaggcgatcgtcgacattcctgagattcctgggttcaaggacttggagc
ccatggagcagttcatcgcacaggtcgatctgtgtgtggactgcacaact
ggctgcctcaaagggcttgccaacgtgcagtgttctgacctgctcaagaa
gtggctgccgcaacgctgtgcgacctttgccagcaagatccagggccagg
tggacaagatcaagggggccggtggtgaca*aagagg*aatgcggtagaggtt
ttaaagagagagccactgaattacttgcccctttag Proinsulin Mouse (nucleic acid sequence):

(SEQ ID NO: 141)

Atgggcctgtggatgcgcttcctgcccctgctggccctgctcttcctctg
ggagtcccaccccacccaggcttttgtcaagcagcacctttgtggttccc
acctggtggaggctctctacctggtgtgtggggagcgtggcttcttctac
acacccatgtcccgccgtgaagtggaggacccacaagtggcacaactgga
gctgggtggaggcccgggagcaggtgaccttcagaccttggcactggagg
tgcccagcag*aagagg*aagcccaccgagaacaacgaagacttcaacatc
gtggccgtggccagcaacttcgcgaccacggatctcgatgctgaccgcgg
gaagttgcccggcaagaagctgccgctggaggtgctcaaagagatggaag
ccaatgcccggaaagctggctgcaccaggggctgtctgatctgcctgtcc
cacatcaagtgcacgcccaagatgaagaagttcatcccaggacgctgcca
cacctacgaaggcgacaaagagtccgcacagggcggcataggcgaggcga
tcgtcgacattcctgagattcctgggttcaaggacttggagcccatggag
cagttcatcgcacaggtcgatctgtgtgtggactgcacaactggctgcct
caaagggcttgccaacgtgcagtgttctgacctgctcaagaagtggctgc
cgcaacgctgtgcgacctttgccagcaagatccagggccaggtggacaag
atcaagggggccggtggtgaca*aagcgt*ggcattgtagatcagtgctgcac
cagcatctgctccctctaccagctggagaactactgcaactag Proinsulin Human (nucleic acid sequence):

(SEQ ID NO: 142)

Atgccctgtggatgcgcctcctgcccctgctggcgctgctggccctctg
gggacctgacccagccgcagcctttgtgaaccaacacctgtgcggctcac
acctggtggaagctctctacctagtgtgcggggaacgaggcttcttctac
acacccaagacccgccgggaggcagaggacctgcaggtggggcaggtgga

```
gctgggcgggggccctggtgcaggcagcctgcagcccttggccctggagg
ggtccctgcagaagaggaagcccaccgagaacaacgaagacttcaacatc
gtggccgtggccagcaacttcgcgaccacggatctcgatgctgaccgcgg
gaagttgccggcaagaagctgccgctggaggtgctcaaagagatgaag
ccaatgcccggaaagctggctgcaccagggcgtctgatctgcctgtcc
cacatcaagtgcacgcccaagatgaagaagttcatcccaggacgctgcca
cacctacgaaggcgacaaagagtccgcacagggcggcataggcgaggcga
tcgtcgacattcctgagattcctgggttcaaggacttggagcccatggag
cagttcatcgcacaggtcgatctgtgtgtggactgcacaactggctgcct
caaagggcttgccaacgtgcagtgttctgacctgctcaagaagtggctgc
cgcaacgctgtgcgaccttttgccagcaagatccagggccaggtggacaag
atcaaggggccggtggtgacaagcgtggcattgtggaacaatgctgtac
cagcatctgctccctctaccagctggagaactactgcaactag
```

Proglucagon (includes GRPP, glucagon. GLP-1,
GLP-2) Mouse (nucleic acid sequence):

(SEQ ID NO: 143)
```
Atgaagaccatttactttgtggctggattgcttataatgctggtgcaagg
cagctggcagcacgcccttcaagacacagaggagaacccagatcattcc
cagcttcccagacagaagcgcatgaggaccctgatgagtgaatgaagac
aaacgccactcacagggcacattcaccagcgactacagcaaatacctgga
ctcccgccgtgcccaagattttgtgcagtggttgatgaaccaagaga
accggaacaacattgccaaacgtcatgatgaatttgagaggcatgctgaa
gggaccatttaccagtgatgtgagttcttacttggaagggccaggcagcaa
aggaattcattgcttggctggtgaaaggccgaggaaggcgagacttccca
gaagaagtcgccattgccgaggaactcggccgaaaagagaagaaagcccac
cgagaacaacgaagacttcaacatcgtggccgtggccagcaacttcgcg
ccacggatctcgatgctgaccgcgggaagttgccggcaagaagctgccg
ctggaggtgctcaaagagatgaagccaatgcccggaaagctggctgcac
cagggcgtctgatctgcctgtcccacatcaagtgcacgcccaagatga
agaagttcatcccaggacgctgccacacctacgaaggcgacaaagagtcc
gcacagggcggcataggcgaggcgatcgtcgacattcctgagattcctgg
gttcaaggacttggagcccatggagcagttcatcgcacaggtcgatctgt
gtgtggactgcacaactggctgcctcaaagggcttgccaacgtgcagtgt
tctgacctgctcaagaagtggctgccgcaacgctgtgcgacctttgccag
caagatccagggccaggtggacaagatcaaggggccggtggtgacaagc
gcggccgcaggcacgctgatggctccttctctgacgagatgagcaccatt
ctggataatcttgccaccagggacttcatcaactggctgattcaaaccaa
gatcactgacaagaatag
```

Proglucagon (includes GRPP, glucagon, GLP-1,
GLP-2) Human (nucleic acid sequence):

(SEQ ID NO: 144)
```
atgaaaagcatttactttgtggctggattatttgtaatgctggtacaagg
cagctggcaacgttcccttcaagacacagaggagaaatccagatcattct
cagcttcccaggcagacccactcagtgatcctgatcagatgaacgaggac
aagcgccattcacagggcgtgcccaagattttgtgcagtggttgatgaataccaagagga
acaggaataacattgccaaacgtcacgatgaatttgagagacatgctgaa
gggacctttaccagtgatgtaagttctttatttggaaggccaagctgcca
ggaattcattggctggtgaaaggccgaggaaggcgagatttcccag
aagaggtcgccattgttgaagaacttggccgaaagaagaaaagcccacc
gagaacaacgaagacttcaacatcgtggccgtggccagcaacttcgcgac
cacggatctcgatgctgaccgcgggaagttgccccggcaagaagctgccgc
tggaggtgctcaaagagatggaagccaatgcccggaaagctggctgcac
aggggctgtctgatctgcctgtcccacatcaagtgcacgcccaagatgaa
gaagttcatcccaggacgctgccacacctacgaaggcgacaaagagtccg
cacagggcggcataggcgaggcgatcgtcgacattcctgagattcctggg
ttcaaggacttggagcccatggagcagttcatcgcacaggtcgatctgtg
tgtggactgcacaactggctgcctcaaagggcttgccaacgtgcagtgtt
ctgacctgctcaagaagtggctgccgcaacgctgtgcgacctttgccagc
aagatccagggccaggtggacaagatcaaggggccggtggtgacaagcg
cggccgcagacatgctgatggttctttctctgatgagatgaacaccattc
ttgataatcttgccgccagggactttataaactggttgattcagaccaaa
atcactgacaggaaataa
```

Peptide YY Mouse (nucleic acid sequence):

(SEQ ID NO: 145)
```
atggtggccggtgcgcaggccttggcccgtcacgtgcgcaatgctgctaat
cctgctcgcctgtctgggagccctggtggacgcctaccctgccaaaccag
aggctcccggcgaagacgcctcccggaggagctgagccgctactacgcc
tccctgcgccactacctcaacctggtcacccggcagcggtatggaaaaag
aaagcccaccgagaacaacgaagacttcaacatcgtggccgtggccagca
acttcgcgaccacggatctcgatgctgaccgcgggaagttgccccggcaag
aagctgccgctggaggtgctcaaagagatggaagccaatgcccggaaagc
tggctgcaccagggctgtctgatctgcctgtcccacatcaagtgcacgc
ccaagatgaagaagttcatcccaggacgctgccacacctacgaaggcgac
aaagagtccgcacagggcggcataggcgaggcgatcgtcgacattcctga
gattcctgggttcaaggacttggagcccatggagcagttcatcgcacagg
tcgatctgtgtgtggactgcacaactggctgcctcaaagggcttgccaac
gtgcagtgttctgacctgctcaagaagtggctgccgcaacgctgtgcgac
ctttgccagcaagatccagggccaggtggacaagatcaaggggccggtg
gtgacaagcaggagggatgtccccgcagctctgttctccaaactgctcttc
acagacgacagcgacagcgagaacctcccctttcaggccagaaggtttgga
ccagtggtga
```

Peptide YY Human (nucleic acid sequence):

(SEQ ID NO: 146)
```
Atggtgttcgtgcgcaggccgtggcccgccttgaccacagtgcttctgg
cctgctcgtctgcctaggggcgctggtcgacgcctaccccatcaaacccg
aggctcccggcgaagacgcctcgccgaggagctgaaccgctactacgcc
tccctgcgccatacctcaacctggtcacccggcagcggtatgggaaaag
aaagcccaccgagaacaacgaagacttcaacatcgtggccgtggccagca
acttcgcgaccacggatctcgatgctgaccgcgggaagttgccccggcaag
aagctgccgctggaggtgctcaaagagatggaagccaatgcccggaaagc
tggctgcaccagggctgtctgatctgcctgtcccacatcaagtgcacgc
ccaagatgaagaagttcatcccaggacgctgccacacctacgaaggcgac
aaagagtccgcacagggcggcataggcgaggcgatcgtcgacattcctga
gattcctgggttcaaggacttggagcccatggagcagttcatcgcacagg
tcgatctgtgtgtggactgcacaactggctgcctcaaagggcttgccaac
gtgcagtgttctgacctgctcaagaagtggctgccgcaacgctgtgcgac
ctttgccagcaagatccagggccaggtggacaagatcaaggggccggtg
gtgacaagaggagggacgcccggacacgcttcttccaaaacgttcttc
cccgacggcgaggaccgccccgtcaggtcgcggtcggagggcccagacct
gtggtga
```

Neuropeptide Y Mouse (nucleic acid sequence):

(SEQ ID NO: 147)
```
Atgctaggtaacaagcgaatgggctgtgtggactgaccctcgctctatc
tctgctcgtgtgtttgggcattctggctgaggggtacccctccaagccgg
acaatccgggcgaggacgcgccagcagaggacatggccagatactactcc
gctctgcgacactacatcaatctcatcaccagcagagatatggcaagag
aaagcccaccgagaacaacgaagacttcaacatcgtggccgtggccagca
acttcgcgaccacggatctcgatgctgaccgcgggaagttgccccggcaag
aagctgccgctggaggtgctcaaagagatggaagccaatgcccggaaagc
tggctgcaccagggctgtctgatctgcctgtcccacatcaagtgcacgc
ccaagatgaagaagttcatcccaggacgctgccacacctacgaaggcgac
aaagagtccgcacagggcggcataggcgaggcgatcgtcgacattcctga
gattcctgggttcaaggacttggagcccatggagcagttcatcgcacagg
tcgatctgtgtgtggactgcacaactggctgcctcaaagggcttgccaac
gtgcagtgttctgacctgctcaagaagtggctgccgcaacgctgtgcgac
ctttgccagcaagatccagggccaggtggacaagatcaaggggccggtg
gtgacaagaggaggtccagccctgagacactgatttcagacctcttaatg
aaggaaagcacagaaaacgccccagaacaaggcttgaagacccttccat
gtggtga
```

Neuropeptide Y Human (nucleic acid sequence):

(SEQ ID NO: 148)
```
Atgctaggtaacaagcgactgggctgtccggactgaccctcgccctgtc
cctgctcgtgtgcctgggtgcgctggccgaggcgtaccctccaagccgg
acaaccgggcgaggacgcaccagcagaggacatggccagatactactcg
gcgctgcgacactacatcaacctcatcaccaggcagagatatgaaaacg
aaagcccaccgagaacaacgaagacttcaacatcgtggccgtggccagca
acttcgcgaccacggatctcgatgctgaccgcgggaagttgccccggcaag
aagctgccgctggaggtgctcaaagagatggaagccaatgcccggaaagc
tggctgcaccagggctgtctgatctgcctgtcccacatcaagtgcacgc
ccaagatgaagaagttcatcccaggacgctgccacacctacgaaggcgac
aaagagtccgcacagggcggcataggcgaggcgatcgtcgacattcctga
gattcctgggttcaaggacttggagcccatggagcagttcatcgcacagg
tcgatctgtgtgtggactgcacaactggctgcctcaaagggcttgccaac
gtgcagtgttctgacctgctcaagaagtggctgccgcaacgctgtgcgac
ctttgccagcaagatccagggccaggtggacaagatcaaggggccggtg
gtgacaagaggaggtccagccagagacactgatttcagacctcttgatg
agagaacacagaaaatgttcccagaactcggcttgaagaccctgcaat
gtggtga
```

Pancreatic polypeptide Mouse (nucleic acid
sequence):

(SEQ ID NO: 149)
```
Atgccgtcgcatactgctgcctctccctgtttctcgtatccacttgggt
ggctctgctgctgcagcccctgcaggggacctggggagcccccctggagc
caatgtacccaggcgactatgcgacacctgagcagatggcacaatatgaa
actcagctccgcagatacatcaacatgctgaccaggccctaggtatggaa
gagaaagcccaccgagaacaacgaagacttcaacatcgtggccgtggcca
gcaacttcgcgaccacggatctcgatgctgaccgcgggaagttgccggc
aagaagctgccgctggaggtgctcaaagagatggaagccaatgcccggaa
agctggctgcaccagggctgtctgatctgcctgtcccacatcaagtgca
cgcccaagatgaagaagttcatcccaggacgctgccacacctacgaaggc
```

-continued gacaaagagtccgcacagggcggcataggcgaggcgatcgtcgacattcc
tgagattcctgggttcaaggacttggagcccatggagcagttcatcgcac
aggtcgatctgtgtgtggactgcacaactggctgcctcaaagggcttgcc
aacgtgcagtgttctgacctgctcaagaagtggctgccgcaacgctgtgc
gacctttgccagcaagatccagggccaggtggacaagatcaagggggccg
gtggtgaca<u>aagaggaggg</u>ccgaggaggagaacacaggtggacttcctgga
gtgcagctctcccctgcaccagcccccagttggcttgattccctgctc
tgcgccctggagctga Pancreatic polypeptide Human (nucleic acid
sequence):
(SEQ ID NO: 150)
Atggctgccgcacgcctctgcctctccctgctgctcctgtccacctgcgt
ggctctgttactacagccactgctgggtgcccagggagcccactggagc
cagtgtacccagggacaatgccacaccagagcagatggccccagtatgca
gctgatctccgtagatacatcaacatgctgaccaggcctaggtatggaa
aagaaagccaccgagaacaacgaagacttcaacatcgtggccgtggcca
gcaacttcgcgaccacggatctcgatgctgaccgcgggaagttgcccggc
aagaagctgccgctggaggtgctcaaagagatggaagccaatgcccggaa
agctggctgcaccaggggctgtctgatctgcctgtcccacatcaagtgca
cgcccaagatgaagaagttcatcccaggacgctgccacacctacgaaggc
gacaaagagtccgcacagggcggcataggcgaggcgatcgtcgacattcc
tgagattcctgggttcaaggacttggagcccatggagcagttcatcgcac
aggtcgatctgtgtgtggactgcacaactggctgcctcaaagggcttgcc
aacgtgcagtgttctgacctgctcaagaagtggctgccgcaacgctgtgc
gacctttgccagcaagatccagggccaggtggacaagatcaagggggccg
gtggtgaca<u>aagaggagg</u>cacaaagaggacacggccttctcggagtgg
gggtccccgcatgctgctgtccccagggagctcagcccgctggacttata
a Somatostatin Mouse (nucleic acid sequence):
(SEQ ID NO: 151)
Atgctgtcctgccgctccagtgcgccctggctgcgctctgcatcgtcct
ggctttgggcggtgtcaccggcgcgccctcggaccccagatccgtcagt
ttctgcagaagtctctggcggctgccaccgggaaacaggaactggccaag
tacttcttggcagagct<u>gcgcaaaaag</u>ccaccgagaacaacgaagactt
caacatcgtggccgtggccagcaacttcgcgaccacggatctcgatgctg
accgcgggaagttgcccggcaagaagctgccgctggaggtgctcaaagag
atggaagccaatgcccggaaagctggctgcaccaggggctgtctgatctg
cctgtcccacatcaagtgcacgcccaagatgaagaagttcatcccaggac
gctgccacacctacgaaggcgacaaagagtccgcacagggcggcataggc
gaggcgatcgtcgacattcctgagattcctgggttcaaggacttggagcc
catggagcagttcatcgcacaggtcgatctgtgtgtggactgcacaactg
gctgcctcaaagggcttgccaacgtgcagtgttctgacctgctcaagaag
tggctgccgcaacgctgtgcgacctttgccagcaagatccagggccaggt
ggacaagatcaaggggccggtggtgac<u>cgcaaa</u>ctgtccgagcccaacc
agacaggagaatgatgccctggagcctgaagatctgtcccaggctgctgag
caggacgagatgaggctggagctgcagaggtctgccaactcgaacccagc
aatggcaccccgggaacgcaaagctggctgcaagaacttcttctggaaga
cattcacatcctgttag Somatostatin Human (nucleic acid sequence):
(SEQ ID NO: 152)
Atgctgtcctgccgcctccagtgcgcgctggctgcgctgtccatcgtcct
ggcctgggcgtgtcaccggcgctccctcggacccccagatccgtcagt
ttctgcagaagtccctggctgctgccgcgggaagcaggaactggccaag
tacttcttggcagagct<u>gcgcaaaaag</u>ccaccgagaacaacgaagactt
caacatcgtggccgtggccagcaacttcgcgaccacggatctcgatgctg
accgcgggaagttgcccggcaagaagctgccgctggaggtgctgtcgatctg
atggaagccaatgcccggaaagctggctgcaccaggtgtctgatctg
cctgtcccacatcaagtgcacgcccaagatgaagaagttcatcccaggac
gctgccacacctacgaaggcgacaaagagtccgcacagggcggcataggc
gaggcgatcgtcgacattcctgagattcctgggttcaaggacttggagcc
catggagcagttcatcgcacaggtcgatctgtgtgtggactgcacaactg
gctgcctcaaagggcttgccaacgtgcagtgttctgacctgctcaagaag
tggctgccgcaacgctgtgcgacctttgccagcaagatccagggccaggt
ggacaagatcaaggggccggtggtgac<u>cgcaaa</u>ctgtctgaacccaacc
agacggagaatgatgccctggaacctgaagatctgtcccaggctgctgag
caggatgaaatggaagcttgagctgcagagatctgctaactcaaacccggc
tatggcaccccgagaacgcaaagctggctgcaagaatttcttctggaaga
ctttcacatcctgttag GHRH Mouse (nucleic acid sequence):
(SEQ ID NO: 153)
Atgctgctctgggtgctctttgtgatcctcatcctcaccagtggctccca
ctgctcactgccccctcacctcccttcaggatgcagcgacacgtagatg
ccatcttcaccaccaactacaggaaactcctgagccagctgtatgcccgg
aaagtgatccaggacatcatgaacaagcaaggggagaggatccaggaaca
aagggccaggctcagccgccaggaagacagcatgtggacagaggacagc agatgaccctggagagcatc<u>cgcgcg</u>aagcccaccgagaacaacgaagac
ttcaacatcgtggccgtggccagcaacttcgcgaccacggatctcgatgc
tgaccgcgggaagttgcccggcaagaagctgccgctggaggtgctcaaag
agatggaagccaatgcccggaaagctggctgcaccaggggctgtctgatc
tgcctgtcccacatcaagtgcacgcccaagatgaagaagttcatcccagg
acgctgccacacctacgaaggcgacaaagagtccgcacagggcggcatag
gcgaggcgatcgtcgacattcctgagattcctgggttcaaggacttggag
cccatggagcagttcatcgcacaggtcgatctgtgtgtggactgcacaac
tggctgcctcaaagggcttgccaacgtgcagtgttctgacctgctcaaga
agtggctgccgcaacgctgtgcgacctttgccagcaagatccagggccag
gtggacaagatcaaggggccggtggtgac<u>cgcggt</u>tgcagggattccc
aaggatgaagccttcagcggacgcttga GHRH Human (nucleic acid sequence):
(SEQ ID NO: 154)
Atgccactctgggtgttcttcttttgtgatcctcaccctcagcaacagctc
ccactgctccccacctcccccttttgaccctcaggatgcggcggtatgcag
atgccatcttcaccaacagctaccggaaggtgctgggccagctgtccagc
cgcaagctgctccaggacatcgtgagcaggcagcagggagagagcaacca
agagcgaggagcaagggcacggcttggtcgtcaggtagacagcatgtggg
cagaacaaaagcaaatggaattggagagcatcctggtggccct<u>gcggcgg</u>
aagcccaccgagaacaacgaagacttcaacatcgtggccgtggccagcaa
cttcgcgaccacggatctcgatgctgaccgcgggaagttgcccggcaaga
agctgccgctggaggtgctcaaagagatggaagccaatgcccggaaagct
ggctgcaccaggggctgtctgatctgcctgtcccacatcaagtgcacgcc
caagatgaagaagttcatcccaggacgctgccacacctacgaaggcgaca
aagagtccgcacagggcggcataggcgaggcgatcgtcgacattcctgag
attcctgggttcaaggacttggagcccatggagcagttcatcgcacaggt
cgatctgtgtgtggactgcacaactggctgcctcaaagggcttgccaacg
tgcagtgttctgacctgctcaagaagtggctgccgcaacgctgtgcgacc
tttgccagcaagatccagggccaggtggacaagatcaaggggccggtgg
tgac<u>cgcggt</u>ctgcagaagcacaggaactcccagggatga POMC (ACTH, MSH) Mouse (nucleic acid sequence):
(SEQ ID NO: 155)
Atgccgagattctgctacagtcgctcaggggccctgttgctggccctcct
gcttcagacctccatagatgtgtggagctggtgcctggagagcagccagt
gccaggacctcaccacggagagcaacctgctggcttgcatccgggcttgc
aaactcgacctctcgctggaagacgcccgtgtttcctggcaacggagatga
acagcccctgactgaaaccccccgaagtacgtcatgggtcacttccgct
gggaccgcttcggcccaggaacagcagcagtgctggcagcgcggcgcag
aggcgtgcggaggaagaggcggtgtgggagatggcagtccagagccgag
tccacgcaggg<u>caagcgc</u>aagcccaccgagaacaacgaagacttcaaca
tcgtggccgtggccagcaacttcgcgaccacggatctcgatgctgaccgc
gggaagttgcccggcaagaagctgccgctggaggtgctcaaagagatgga
agccaatgcccggaaagctggctgcaccaggggctgtctgatctgcctgt
cccacatcaagtgcacgcccaagatgaagaagttcatcccaggacgctgc
cacacctacgaaggcgacaaagagtccgcacagggcggcataggcgaggc
gatcgtcgacattcctgagattcctgggttcaaggacttggagcccatgg
agcagttcatcgcacaggtcgatctgtgtgtggactgcacaactggctgc
ctcaaagggcttgccaacgtgcagtgttctgacctgctcaagaagtggct
gccgcaacgctgtgcgacctttgccagcaagatccagggccaggtggaca
agatcaaggggccggtggtgac<u>aagcgct</u>cctactccatggagcacttc
cgctggggcaagccggtgggcaagaaacggcgccggtgaaggtgtaccc
caacttgctggcaacgagtcggccgaggcctttccccctagagttcaaga
gggagctggaaggcgagcgagccattaggctggagcaggtcctggagtcc
gacgcggagaaggacgacgggccctaccgggtggagcacttccgctggag
caacccgcccaaggacaagcgttacggtggcttcatgacctccgagaaga
gccagacgcccctggtgacgctcttcaagaacgccatcatcaagaacgcg
cacaagaagggccagtga POMC (ACTH, MSH) Human (nucleic acid sequence):
(SEQ ID NO: 156)
Atgccgagatcgtgctgcagccgctcggggggccctgttgctggccctcct
gcttcaggcctccatggaagtgcgtggctggtgcctggagagcagccagt
gtcaggacctcaccacggaaagcaacctgctggagtcatccgggcctgc
aagcccgacctctcggccgagactccatgttcccgggaaatggcgacga
gcagcctctgaccgagaaccccggaagtacgtcatgggccacttccgct
gggaccgatccggccgccaacagcagcagcagcagcagcagcggcca
gggcagaagcgcgaggacgtctcagccgccgaagactcgggcccgctgcc
tgagggcggccccgagccccgcagcgatggtgccaagcggggccgcgcg
aggg<u>aagcgc</u>aagcccaccgagaacaacgaagacttcaacatcgtggcc
gtggccagcaacttcgcgaccacggatctcgatgctgaccgcgggaagtt
gcccggcaagaagctgccgctggaggtgctcaaagagatggaagccaatg
cccggaaagctggctgcaccaggggctgtctgatctgcctgtcccacatc
aagtgcacgcccaagatgaagaagttcatcccaggacgctgccacaccta
cgaaggcgacaaagagtccgcacagggcggcataggcgaggcgatcgtcg
acattcctgagattcctgggttcaaggacttggagcccatggagcagttc
atcgcacaggtcgatctgtgtgtggactgcacaactggctgcctcaaagg gcttgccaacgtgcagtgttctgacctgctcaagaagtggctgccgcaac
gctgtgcgacctttgccagcaagatccagggccaggtggacaagatcaag
ggggccggtggtgacaagcgctcctactccatggagcacttccgctgggg
caagccggtgggcaagaagcggcgcccagtgaaggtgtaccctaacggcc
ccgaggacgagtcggccgaggccttccccctggagttcaagagggagctg
actgccagcgactccggagggagatggccccgacggcccctgccgatga
cggcgcaggggcccaggccgacctggagcacagcctgctggtggcggccg
agaagaaggacgagggcccctacaggatggagcacttccgctggggcagc
ccgcccaaggacaagcgctacggcggtttcatgacctccgagaagagcca
gacgcccctggtgacgctgttcaaaaacgccatcatcaagaacgcctaca
agaagggcgagtga Oxytocin Mouse (nucleic acid sequence):
(SEQ ID NO: 157)
Atggcctgccccagtctcgcttgctgcctgcttggcttactggctctgac
ctccggcctgctacatccagaactgcccctggggcgg*aagagg*aagccca
ccgagaacaacgaagacttcaacatcgtggccgtggccagcaacttcgcg
accacggatctcgatgctgaccgcgggaagttgcccggcaagaagctgcc
gctggaggtgctcaaagagatggaagccaatgcccggaaagctggctgca
ccaggggctgtctgatctgcctgtcccacatcaagtgcacgcccaagatg
aagaagttcatcccaggacgctgccacacctacgaaggcgacaaagagtc
cgcacaggcggcataggcgaggcgatcgtcgacattcctgagattcctg
ggttcaaggacttggagcccatggagcagttcatcgcacaggtcgatctg
tgtgtggactgcacaactggctgcctcaaagggcttgccaacgtgcagtg
ttctgacctgctcaagaagtggctgccgcaacgctgtgcgacctttgcca
gcaagatccagggccaggtggacaagatcaaggggggccggtggtgacaag
cgcgctgtgctggacctggatatgcgcaagtgtctccctcgggcccggg
cggcaaggacgctgcttcggaccaagcatctgctgcgcggacgagctgg
gctgcttcgtgggcaccgccgaggcgctgcgctgccaggaggagaactac
ctgcctcgccctgccagtctggccagaaggcgtgcgggacggaggccg
ctgccgccacagcatctgctgcagcccggatggctgccgcacagacc
ccgcctgcgaccctgagtctgccttctcggagcgctga Oxytocin Human (nucleic acid sequence):
(SEQ ID NO: 158)
Atggccggccccagcctcgcttgctgtctgctcggcctcctggcgctgac
ctccggcctgctacatccagaactgcccctggggagg*aagagg*aagccca
ccgagaacaacgaagacttcaacatcgtggccgtggccagcaacttcgcg
accacggatctcgatgctgaccgcgggaagttgcccggcaagaagctgcc
gctggaggtgctcaaagagatggaagccaatgcccggaaagctggctgca
ccaggggctgtctgatctgcctgtcccacatcaagtgcacgcccaagatg
aagaagttcatcccaggacgctgccacacctacgaaggcgacaaagagtc
cgcacaggcggcataggcgaggcgatcgtcgacattcctgagattcctg
ggttcaaggacttggagcccatggagcagttcatcgcacaggtcgatctg
tgtgtggactgcacaactggctgcctcaaagggcttgccaacgtgcagtg
ttctgacctgctcaagaagtggctgccgcaacgctgtgcgacctttgcca
gcaagatccagggccaggtggacaagatcaaggggggccggtggtgacaag
cgcgccgccggacctcgacgtgcgcaagtgcctccctcgggcccggg
gggcaaggccgctgcttcgggccaatatctgctgcgcggaagagctgg
gctgcttcgtgggcaccgccgaagcgctgcgctgccaggaggagaactac
ctgcctcgccccagtccagccagaaggcgtgggggcggggggccg
ctgccgcggtcttgggcctctgctgcagcccggacggctgccacgccacc
ctgcctgcgacgcggaagccaccttctcccagcgctga Vasopressin-Neurophysin-2 Mouse (nucleic acid sequence):
(SEQ ID NO: 159)
atgctcgccaggatgctcaacactacgctctccgcttgtttcctgagcct
gctggccttctctcctccgcctgctactccagaactgcccaaggggcca
*aqaqq*aagccaccgagaacaacgaagacttcaacatcgtggccgtggcca
gcaacttcgcgaccacggatctcgatgctgaccgcgggaagttgcccgg
caagaagctgccgctggaggtgctcaaagagatggaagccaatgcccgga
aagctggctgcaccaggggctgtctgatctgcctgtcccacatcaagtgc
acgcccaagatgaagaagttcatcccaggacgctgccacacctacgaagg
cgacaaagagtccgcacaggcggcataggcgaggcgatcgtcgacattc
ctgagattcctgggttcaaggacttggagcccatggagcagttcatcgca
caggtcgatctgtgtgtggactgcacaactggctgcctcaaagggcttgc
caacgtgcagtgttctgacctgctcaagaagtggctgccgcaacgctgtg
cgacctttgccagcaagatccagggccaggtggacaagatcaaggg
ggtggtgac*aagcgc*gccatctctgacatggagctgagacagtgtctccc
ctgcggcccggcggcaaggacgctgcttcggaccaagcatctgctgcg
cggacgagctgggctgcttcgtgggcaccgccgaggcgctgcgctgccag
gaggagaactacctgcctcgccctgccagtccggccagaagccctgcgg
gagcggggggccgctgccgccgcggtgcatctgctgccgcgacgagagct
cgtgggccgagcccgagtgccacgacggttttttccgcctcacccgcgct
cgggagccaagcaacgccacacagctggacgcctgctcgggcgctgct
gctaaggctggtacagctggctgggacacgggagtccgtggattctgcca
agccccgggtctactga Vasopressin-Neurophysin-2 Human (nucleic acid sequence):
(SEQ ID NO: 160)
Atgcctgacaccatgctgcccgcctgcttcctcggcctactggccttctc
ctccgcgtgctacttccagaactgcccgagggcggc*aagagg*aagccca
ccgagaacaacgaagacttcaacatcgtggccgtggccagcaacttcgcg
accacggatctcgatgctgaccgcgggaagttgcccggcaagaagctgcc
gctggaggtgctcaaagagatggaagccaatgcccggaaagctggctgca
ccaggggctgtctgatctgcctgtcccacatcaagtgcacgcccaagatg
aagaagttcatcccaggacgctgccacacctacgaaggcgacaaagagtc
cgcacaggcggcataggcgaggcgatcgtcgacattcctgagattcctg
ggttcaaggacttggagcccatggagcagttcatcgcacaggtcgatctg
tgtgtggactgcacaactggctgcctcaaagggcttgccaacgtgcagtg
ttctgacctgctcaagaagtggctgccgcaacgctgtgcgacctttgcca
gcaagatccagggccaggtggacaagatcaaggggggccggtggtgac*aag
cgc*gccatgtccgacctggagctgagacagtgcctccctcgggcccccgg
gggcaaaggccgctgcttcgggccagcatctgctgcgcggacgagctgg
gctgcttcgtgggcacgctgaggcgctgcgctgccaggaggagaactac
ctgccgtcgccctgccagtccggccagaaggcgtgcgggagcggggccg
ctgccgtcgccttcggcgtttgctgcaacgacgagagctgcgtgaccgagc
ccgagtgccgcgagggcttcaccgccgcgcccgccagcgaccggagc
aaccgccacagctggacggggccggccggggccttgctgctgcggctggt
gcagctggccggggcgcccgagccctttcgagcccgcccagcccgacgct
actga Gonadotropin-releasing hormone (GnRH) Mouse (nucleic acid sequence):
(SEQ ID NO: 161)
Atgatcctcaaactgatggccggcattctactgctgactgtgtgtttgga
aggctgctccagccagcactggtcctatggggttgcgccctgggg*aaaga
ga*aagccaccgagaacaacgaagacttcaacatcgtggccgtggccagc
aacttcgcgaccacggatctcgatgctgaccgcgggaagttgcccggcaa
gaagctgccgctggaggtgctcaaagagatggaagccaatgcccggaaag
ctggctgcaccaggggctgtctgatctgcctgtcccacatcaagtgcacg
cccaagatgaagaagttcatcccaggacgctgccacacctacgaaggcga
caaagagtccgcacaggcggcataggcgaggcgatcgtcgacattcctg
agattcctgggttcaaggacttggagcccatggagcagttcatcgcacag
gtcgatctgtgtgtggactgcacaactggctgcctcaaagggcttgccaa
cgtgcagttctgacctgctcaagaagtggctgccgcaacgctgtgcga
cctttgccagcaagatccagggccaggtggacaagatcaagggggccggt
ggtgac*aagcgc*aacactgaacacttggttgagtcttccaagagatggg
caaggaggtggatcaaatggcagaacccagcacttcgaatgtactgtcc
actggcccgttcaccccctcagggatctgcgaggagctctgaaagtctg
attgaagaggaagccaggcagaagaagatgtag Gonadotropin-releasing hormone (GnRH) Human (nucleic acid sequence):
(SEQ ID NO: 162)
Atgaagccaattcaaaaactcctagctggccttattctactgactggtg
cgtggaaggctgctccagccagcactggtcctatggactgcgccctggag
ga*aagaga*aagccaccgagaacaacgaagacttcaacatcgtggccgtg
gccagcaacttcgcgaccacggatctcgatgctgaccgcgggaagttgcc
cggcaagaagctgccgctggaggtgctcaaagagatggaagccaatgccc
ggaaagctggctgcaccaggggctgtctgatctgcctgtcccacatcaag
tgcacgcccaagatgaagaagttcatcccaggacgctgccacacctacga
aggcgacaaagagtccgcacaggcggcataggcgaggcgatcgtcgaca
ttcctgagattcctgggttcaaggacttggagcccatggagcagttcatc
gcacaggtcgatctgtgtgtggactgcacaactggctgcctcaaagggct
tgccaacgtgcagtgttctgacctgctcaagaagtggctgccgcaacgct
gtgcgacctttgccagcaagatccagggccaggtggacaagatcaagggg
gccggtggtgac*aagcgc*gatgccgaaaatttgattgattcttccaaga
gatagtcaaagaggttggtcaactggcagaaacccaacgcttcgaatgca
ccacgcaccagccacgttctcccctccgagacctgaaggagctctggaa
agtctgattgaagaggaaactgggcagaagaagatttaa Thyroid-stimulating hormone, beta subunit (TSHB) Mouse (nucleic acid sequence):
(SEQ ID NO: 163)
Atgagtgctgccgtcctcctctccgtgcttttttgctcttgcttgtgggca
agcagcatccttttgtattcccactgagtatacaatgtacgtggatagga
gagtgtgcctactgcctgaccatcaacaccaccatcgtgctgggtat
tgtatgacacgggatatcaatggcaaactgtttcttcccaaatatgcact
ctctcaggatgtctgtacatacagagacttcatctacagaacggtgaaa
taccaggatgcccgccaccatgttactccttattctccttccctgtcgcc
ataagctgcaagtggtggcaagtgtaatactgacaacagtgactgcataca
cgaggctgtcagaaccaactactgcaccaagccgcagtcttt*ctatctga*
agcccaccgagaacaacgaagacttcaacatcgtggccgtggccagcaac
ttcgcgaccacggatctcgatgctgaccgcgggaagttgcccggcaagaa
gctgccgctggaggtgctcaaagagatggaagccaatgcccggaaagctg gctgcaccaggggctgtctgatctgcctgtcccacatcaagtgcacgccc
aagatgaagaagttcatcccaggacgctgccacacctacgaaggcgacaa
agagtccgcacagggcggcataggcgaggcgatcgtcgacattcctgaga
ttcctgggttcaaggacttggagcccatggagcagttcatcgcacaggtc
gatctgtgtgtggactgcacaactggctgcctcaaagggcttgccaacgt
gcagtgttctgacctgctcaagaagtggctgccgcaacgctgtgcgacct
tgccagcaagatccagggccaggtggacaagatcaaggggccggtggt
gac<u>tatctg</u>ggggattttctgttttaa Thyroid-stimulating hormone, beta subunit (TSHB)
Human (nucleic acid sequence):

(SEQ ID NO: 164)
Atgactgctctcttctgatgtccatgcttttttggccttacatgtgggca
agcgatgtcttttttgtattccaactgagtataCaatgcacatgaaagga
gagagtgtgcttattgcctaaccatcaacaccaccatctgtgctggatat
tgtatgacacgggatatcaatggcaaactgttttcttcccaaatatgctct
gtcccaggatgtttgcacatatagagacttcatctacaggactgtagaaa
taccaggatgccactccatgttgctccctatttttcctatcctgttgct
ttaagctgtaagtgtggcaagtgcaatactgactatagtgactgcataca
tgaagccatcaagacaaactactgtaccaaacctcagaagtc<u>tatctga
agcccaccgagaacaacgaagcttcaacatcgtggccgtggccagcaac
ttcgcgaccacggatctcgatgctgaccgcgggaagttgcccggcaagaa
gctgccgctggaggtgctcaaagagatggaagccaatgcccggaaagctg
gctgcaccaggggctgtctgatctgcctgtcccacatcaagtgcacgccc
aagatgaagaagttcatcccaggacgctgccacacctacgaaggcgacaa
agagtccgcacagggcggcataggcgaggcgatcgtcgacattcctgaga
ttcctgggttcaaggacttggagcccatggagcagttcatcgcacaggtc
gatctgtgtgtggactgcacaactggctgcctcaaagggcttgccaacgt
gcagtgttctgacctgctcaagaagtggctgccgcaacgctgtgcgacct
tgccagcaagatccagggccaggtggacaagatcaaggggccggtggt
gac<u>tatctg</u>gtaggattttctgtctaa Cortisol-releasing factor (CRF) Mouse (nucleic
acid sequence):

(SEQ ID NO: 165)
Atgcggctgcggctgctggtgtccgcgggcatgctgctggtggctctgtc
gtcctgcctgccttgcagggccctgctcagcaggggatccgtccccgag
cgccgcgggccccgcagccttgaatttcttgcagccggagcagcccag
caacctcagccggttctgatccgcatggagtgagaagtacttcctccgct
gggggaatctcaacagaagtcccgctgctcggctgtccccaactccacgc
ccctcaccgcgggtcgcggcagccgcccctcgcacgaccaggctgcggct
aactttttccgcgtgttgctgcagcagctgcagatgcctcagcgctcgct
cgacagccgcgcggagcggcgaagctgccgcgggccgcgaagctgccgctg
gccaccaggggcgctggagagga<u>gaggcgg</u>aagcccaccgagaacaac
gaagacttcaacatcgtggccgtggccagcaacttcgcgaccacggatct
cgatgctgaccgcgggaagttgcccggcaagaagctgccgctggaggtgc
tcaaagagatggaagccaatgcccggaaagctggctgcaccaggggcgc
tgatctgcctgtcccacatcaagtgcacgcccaagatgaagaagttcat
cccaggacgctgccacacctacgaaggcgacaaagagtccgcacagggcg
gcataggcgaggcgatcgtcgacattcctgagattcctgggttcaaggac
ttggagcccatggagcagttcatcgcacaggtcgatctgtgtgtggactg
cacaactggctgcctcaaagggcttgccaacgtgcagtgttctgacctgc
tcaagaagtggctgccgcaacgctgtgcgaccttgccagcaagatccag
ggccaggtggacaagatcaaggggccggtggtgac<u>aggcggt</u>cggagga
gccgccatctctctgatctcaccttccaccttctgcgggaagtcttgg
aaatggccggcagagcagttagctcagcaagctcacagcaacaggaaa
ctgatgagattatcggaaatga Cortisol-releasing factor (CRF) Human (nucleic
acid sequence):

(SEQ ID NO: 166)
Atgcggctgccgctgcttgtgtccgcgggagtcctgctggtggctctcct
gccctgcccgccatgcagggcgctcctgagccgcgggccggtccccgggag
ctcggcaggcgccgcagcaccctcagccttggatttcttccagccgccg
ccgcagtccgagcagcccagcagccgcaggctcggccggtcctgctccg
catgggagaggagtacttcctccgcctgggggaacctcaacaagaagtcc
ccgctccccttcgcccgcctcctcgctcctcgccggaggcagcggcagc
cgcccttcgccggaacaggcgaccgccaactttttccgcgtgttgctgca
gcagctgctgcctcggcgctcgctcgacagcccgcggctctcgcgg
agcgcggcgctaggaatgcctcggcggccaccaggaggcaccggagaga
gaa<u>aggcgg</u>aagcccaccgagaacaacgaagacttcaacatcgtggccgt
<u>ggccagcaacttcgcgaccacggatctcgatgctgaccgcgggaagttgc
ccggcaagaagctgccgctggaggtgctcaaagagatggaagccaatgcc
cggaaagctggctgcaccaggggcgctgtctgatctgcctgtcccacatcaa
gtgcacgcccaagatgaagaagttcatcccaggacgctgccacacctacg
aaggcgacaaagagtccgcacagggcggcataggcgaggcgatcgtcgac
attcctgagattcctgggttcaaggacttggagcccatggagcagttcat
cgcacaggtcgatctgtgtgtggactgcacaactggctgcctcaaaggc
ttgccaacgtgcagtgttctgacctgctcaagaagtggctgccgcaacgc
tgtgcgacctttgccagcaagatccaggggccaggtggacaagatcaaggg
ggccggtggtgacaggcgg</u>tccgaggagcctcccatctccctggatctca
ccttccacctcctccgggaagtcttggaaatggcccagggccgagcagtta
gcacagcaagctcacagcaacaggaaactcatggagattattgggaaata
a Atrial natriuretic peptide (ANP) Mouse (nucleic
acid sequence):

(SEQ ID NO: 167)
Atgggctccttctccatcaccctgggcttcttcctcgtcttggccttttg
gcttccaggccatattggagcaaatcctgtgtacagtgcggtgtccaaca
cagatctgatggatttcaagaacctgctagaccacctggaggagaagatg
ccggtagaagatgaggtcatgcccccgcaggccctgagtgagcagactga
ggaagcaggggccgcacttagctccctcccccgaggtgcctccctggactg
gggaggtcaacccaccctctgagagacggcagtgctctagggcgcagcccc
tgggaccctccgatagatctgccctcttgaaaagcaaactgagggctct
gctcgctggccctcggagcaagcccaccgagaacaacgaagacttcaaca
tcgtggccgtggccagcaacttcgcgaccacggatctcgatgctgaccgc
gggaagttgcccggcaagaagctgccgctggaggtgctcaaagagatgga
agccaatgcccggaaagctggctgcaccaggggcgctgtctgatctgcctgt
cccacatcaagtgcacgcccaagatgaagaagttcatcccaggacgctgc
cacacctacgaaggcgacaaagagtccgcacagggcggcataggcgaggc
gatcgtcgacattcctgagattcctgggttcaaggacttggagcccatgg
agcagttcatcgcacaggtcgatctgtgtgtggactgcacaactggctgc
ctcaaagggcttgccaacgtgcagtgttctgacctgctcaagaagtggct
gccgcaacgctgtgcgacctttgccagcaagatccagggccaggtggac
aagatcaagggccggtggtgac<u>cggagcc</u>tacgaagatccagctgcttc
gggggtaggattgacaggattggagcccagagtggactaggctgcaacag
cttccggtaccgaagataa Atrial natriuretic peptide (ANP) Human (nucleic
acid sequence):

(SEQ ID NO: 168)
atgagctccttctccaccaccaccgtgagcttcctccttttactggcatt
ccagtcctcaggtcagaccagagctaatcccatgtacaatgccgtgtcca
acgcagacctgatggatttcaagaatttgctggaccattggaagaaaag
atgcctttagaagatgaggtcgtgcccccacaagtgctcagtgagccgaa
tgaagaagcgggggctgctctcagccccctccctgaggtgcctccctga
ccgggggaagtcagccaggcagagagatggaggtgccctcggccgggagc
ccctgggactcctctgatcgatctgccctcctaaaaagcaagctgagggc
gctgctcactgcccct<u>cggagc</u>aagcccaccgagaacaacgaagacttca
acatcgtggccgtggccagcaacttcgcgaccacggatctcgatgctgac
cgcgggaagttgcccggcaagaagctgccgctggaggtgctcaaagagat
ggaagccaatgcccggaaagctggctgcaccaggggctgtctgatctgcc
tgtcccacatcaagtgcacgcccaagatgaagaagttcatcccaggacgc
tgccacacctacgaaggcgacaaagagtccgcacagggcggcataggcga
ggcgatcgtcgacattcctgagattcctgggttcaaggacttggagccca
tggagcagttcatcgcacaggtcgatctgtgtgtggactgcacaactggc
tgcctcaaagggcttgccaacgtgcagtgttctgacctgctcaagaagtg
gctgccgcaacgctgtgcgacctttgccagcaagatccagggccaggtgg
acaagatcaagggccggtggtgac<u>cggagc</u>ctgcggagatccagctgc
ttcggggggcaggatgacaggattggagcccagagcggactgggctgtaa
cagcttccggtactga Brain natriuretic peptide (BNP) Mouse (nucleic
acid sequence):

(SEQ ID NO: 169)
atggatctcctgaaggtgctgtcccagatgattctgtttctgcttttcct
ttatctgtcaccgctgggaggtcactcctatcctctgggaagtcctgagcc
agtctccagagcaaccaagatgcagaagctgctggagctgataagagaaa
agtcggaggaaatggccccagagacagctcttgaaggaccaaggcctcaca
aaagaacacccaaaagagtcctt<u>cggtct</u>aagcccaccgagaacaacga
agacttcaacatcgtggccgtggccagcaacttcgcgaccacggatctcg
atgctgaccgcgggaagttgcccggcaagaagctgccgctggaggtgctc
aaagagatggaagccaatgcccggaaagctggctgcaccaggggctgtct
gatctgcctgtcccacatcaagtgcacgcccaagatgaagaagttcatcc
caggacgctgccacacctacgaaggcgacaaagagtccgcacagggcggc
ataggcgaggcgatcgtcgacattcctgagattcctgggttcaaggactt
ggagcccatggagcagttcatcgcacaggtcgatctgtgtgtggactgca
caactggctgcctcaaagggcttgccaacgtgcagtgttctgacctgctc
aagaagtggctgccgcaacgctgtgcgacctttgccagcaagatccaggg
ccaggtggacaagatcaaggggccggtggtgac<u>cggtct</u>caaggcagca
ccctccgggtcagcagagacctcagttgttgtag Brain natriuretic peptide (BNP) Human (nucleic
acid sequence):

(SEQ ID NO: 170)
Atggatccccagacagcacctcccgggcgctcctgctcctgctcttctt
gcatctggctttcctgggaggtcgttccaccgctgggcagccccggtt -continued cagcctcggacttggaaacgtccgggttacaggagcagcgcaaccatttg
cagggcaaactgtcggagctgcaggtggagcagacatccctggagcccct
ccaggagagccccgtcccacaggtgtctggaagtcccgggaggtagcca
ccgagggcatccgtgggcaccgcaaaatggtcctctacaccctgcggca
cc<u>acgaagc</u>aagccaccgagaacaacgaagacttcaacatcgtggccgt
ggccagcaacttcgcgaccacggatctcgatgctgaccgcgggaagttgc
ccggcaagaagctgccgctggaggtgctcaaagagatggaagccaatgcc
cggaaagctggctgcaccagggctgtctgatctgcctgtcccacatcaa
gtgcacgcccaagatgaagaagttcctcccaggacgctgccacacctacg
aaggcgacaaagagtccgcacagggcgcataggcgcggcgatcgtcgac
attcctgagattcctggggttcaaggacttggagcccatggagcagttcat
cgcacaggtcgatctgtgtgtggactgcacaactggctgcctcaaagggc
ttgccaacgtgcagtgttctgacctgctcaagaagtggccgccgcaacgc
tgtgcgaccttcgccagcaagatccagggccaggtggacaagatcaaggg
ggccggtggtgacc<u>gaagc</u>cgaagccccaagatggtgcaagggtctggct
gctttgggaggaagatggaccggatcagctcctccagtggcctgggctgc
aacgtgctgaggcggcattaa Renin Mouse (nucleic acid sequence):
(SEQ ID NO: 171)
Atggacagaaggaggatgcctctctgggcactcttgttgctctggagtcc
ttgcacctttcagtctcccaacacgcaccgctacctttgaacgaatcccgc
tcaagaaaatgcctctctgtccgggaaatcctggaggagcggggagtggac
atgaccaggctcagtgctgaatggggcgtattcaca<u>aagagg</u>aagcccac
cgagaacaacgaagacttcaacatcgtggccgtggccagcaacttcgcga
ccacggatctcgatgctgaccgcgggaagttgcccggcaagaagctgcc
ctggaggtgctcaaagagatggaagccaatgcccggaaagctggctgcac
caggggctgtctgatctgcctgtcccacatcaagtgcacgcccaagatga
agaagttcatcccaggacgctgccacacctacgaaggcgacaaagagtcc
gcacagggcgcataggcgaggcgatcgtcgacattcctgagattcctgt
gttcaaggacttggagcccatggagcagttcatcgcacaggtcgatctgt
gtgtggactgcacaactggctgcctcaaagggcttgccaacgtgcagtgt
tctgacctgctcacgaagtggctgccgccacgctgtgcgacctttgccag
caagatccagggccaggtggacaagatcaaggggccggtggtgacaaga
gg<u></u>ccttcctgaccaatcttacctcccccgtggtcctcaccaactacctg
aatacccagtactacgcgagattggcatcggtaccccaccccagacctt
caaagtcatctttgacacgggttcagccaacctctgggtgccctccacca
agtgcagccgcctctaccttgcttgtgggattcacagcctctatgagtcc
tctgactcctccagctacatggagaacgggtccgacttcaccatccacta
cggatcaggggagagtcaaaggtttcctcagccaggactcggtgactgtgg
gtggaatcactgtgacacagaccttggagaggtcaccgagctgcccctg
atcccttttcatgctggccaagtttgacggtgttctaggcatgggcttcc
cgctcaggccgttggaggggttaccctgtcttcttttgaccacattctcccc
aggggggtgctaaaggaggaagtgttctctgtctactacaacaggggttcc
cacctgctgggggcgaggtggtgctaggaggtagcgacccgcagcatta
tcaaggcaatttttcactatgtgagcatcagcaagactgactcctggcaga
tcacgatgaaggggtgtctgtgggtcttccaccctgctgctaagggctac
ggctgtgcggtagtggtggacactggttcatctttatctcggctcctac
gagctccctgaagttgatcatgcaagcctgggagccaaggagaagagaa
tagaagaatatgttgtgaactgtagccaggtgcccaccctccccgacatt
tcctttgacctgggaggcagggcctacacactcagcagtacggactacgt
gctacagtatcccaacaggagagacaagctgtgcacactggctctccatg
ccatggacatcccaccaccccactgggcctgtctgggtcctgggtgccacc
ttcatccgcaagttctatacagagtttgatcggcataacaatcgcattgg
attgccttggcccgctaa Renin Human (nucleic acid sequence):
(SEQ ID NO: 172)
Atggatggatggagaaggatgcctcgctggggactgctgctgctgctctg
gggctcctgtaccttggtctcccgacagacaccaccaccttt<u>aaacgga</u>
<i>agcccaccgagaacaacgaagacttcaacatcgtggccgtggccagcaac
ttcgcgaccacggatctcgatgctgaccgcgggaagttgcccggcaagaa
gctgccgctggaggtgctcaaagagatggaagccaatgcccggaaagctg
gctgcaccagggctgtctgatctgcctgtcccacatcaagtgcacgccc
aagatgaagaagttcatcccaggacgctgccacacctacgaaggcgacaa
agagtccgcacagggcggcataggcgaggcgatcgtcgacattcctgaga
ttcctggggttcaaggacttggagcccatggagcagttcatcgcacaggtc
gatctgtgtgtggactgcacaactggctgcctcaaagggcttgccaacgt
gcagtgttctgacctgctcaagaagtggctgccgccaacgctgtgcgacct
tgccagcaagatccagggccaggtggacaagatcaaggggccggtggt
gac<u>aaacgga</u>tcttcctcaagagaatgccctcaatccgagaaagctgaa</i>
ggaacgaggtgtggacatggccaggcttggtcccgagtggagccaaccca
tgaagaggctgacacttggcaacaccacctcctccgtgatcctcaccaac
tacatggacaccaggtcatggcgagattggcgtgccgccaaccacccgga
gaccttcaaagtcgtctttgacactggttcgtccaatgtttgggtgccct
cctccaagtgcagccgtctctacactgcctgtgtgtatcacaagctcttc
gatgcttcggattcctccagctacaagcacaatggaacagaactcaccct
ccgctattcaacagggacagtcagtggctttctcagccaggacatcatca
ccgtgggtggaatcacggtgacacagatgtttggagaggtcacggagatg cccgccttaccctttcatgctggccgagtttgatggggttgtgggcatggg
cttcattgaacaggccattggcagggtcaccccctatcttcgacaacatca
tctcccaagggggtgctaaaagaggacgtcttctcttttctactacaacaga
gattccgagaattcccaatcgctgggaggacagattgtgctgggaggcag
cgacccccagcattacgaaggggaatttccactatatcaacctcatcaaga
ctggtgtctggcagattcaaatgaaggggggtgtctgtgggtgtcatccacc
ttgctctgtgaagacggctgcctggcattggtagacaccggtgcatccta
catctcaggttctaccagctccatagagaagctcatggaggccttgggag
ccaagaaggctgtttgattatgtcgtgaagtgtaacgagggccctaca
ctccccgacatctctttccacctgggaggcaaagaatacacgctcaccag
cgcggactatgtatttcaggaatcctacagtagtaaaaagctgtgcacac
tggccatccacgccatggatatcccgccaccactggacccacctgggcc
ctggggggccaccttcatccgaaagttctacacagagtttgatcggcgtaa
caaccgcattggcttcgccttggcccgctga Galanin Mouse (nucleic acid sequence):
(SEQ ID NO: 173)
Atggccagaggcagcgttatcctgctaggctggctcctgttggttgtgac
cctgtcagccactctgggacttgggatgcctgcaaaggag<u>aagagaggt</u>a
agcccaccgagaacaacgaagacttcaacatcgtggccgtggccagcaac
ttcgcgaccacggatctcgatgctgaccgcgggaagttgccccggcaagaa
gctgccgctggaggtgctcaaagagatggaagccaatgcccggaaagctg
gctgcaccagggctgtctgatctgcctgtcccacatcaagtgcacgccc
aagatgaagaagttcatcccaggacgctgccacacctacgaaggcgacaa
agagtccgcacagggcggcataggcgaggcgatcgtcgacattcctgaga
ttcctggggttcaaggacttggagcccatggagcagttcatcgcacaggtc
gatctgtgtgtggactgcacaactggctgcctcaaagggcttgccaacgt
gcagtgttctgacctgctcaagaagtggctgccgccaacgctgtgcgacct
tgccagcaagatccagggccaggtggacaagatcaaggggccggtggt
gac<u>aagagaggt</u>tggacctgaacagcgctggctacctctgtgggcccaca
tgccattgacaaccacagatcattagcgacaagcatggcctcacaggca
gagggagttacaactggaggtggaggaaggagaccaggaagtgttgat
gtgcccctgcctgagagcaacattgtccgcactataatggagtttctcag
tttcttgcacctttaaaaggccggggccctcgacagcctgcctggcatcc
ccttggccacctcctcagaagacctagagaagtcctga Galanin Human (nucleic acid sequence):
(SEQ ID NO: 174)
Atggcccgaggcagcgccctcctgctcgcctccctcctcctcgccgcggc
cctttctgcctctgcggggctctggtcgccggccaaggaa<u>aaacgaggca</u>
agcccaccgagaacaacgaagacttcaacatcgtggccgtggccagcaac
ttcgcgaccacggatctcgatgctgaccgcgggaagttgccccggcaagaa
gctgccgctggaggtgctcaaagagatggaagccaatgcccggaaagctg
gctgcaccagggctgtctgatctgcctgtcccacatcaagtgcacgccc
aagatgaagaagttcatcccaggacgctgccacacctacgaaggcgacaa
agagtccgcacagggcggcataggcgaggcgatcgtcgacattcctgaga
ttcctggggttcaaggacttggagcccatggagcagttcatcgcacaggtc
gatctgtgtgtggactgcacaactggctgcctcaaagggcttgccaacgt
gcagtgttctgacctgctcaagaagtggctgccgccaacgctgtgcgacct
tgccagcaagatccagggccaggtggacaagatcaaggggccggtggt
gac<u>aaacgaggct</u>ggacagcagcgcggtacctgctgggcccaca
tgccgtggcaaccacaggtcattcagcgacaagaatggcctcaccagca
agcgggagctgcggcccgaagatgacatgaaaccaggaagctttgacagg
tccatacctgaaaacaatatcatgcgcacaatcattgagtttctgtctt
cttgcatctcaaagaggccggtgcctcgaccgcctcctggatctcccg
ccgcagcctcctcagaagacatcgagcggtcctga Orexin Mouse (nucleic acid sequence):
(SEQ ID NO: 175)
Atgaactttccttctacaaaggttccctgggccgccgtgacgctgctgct
gctgctactgctgccgccggcgctgctgtcgcttgggtggacgcacagc
ctctgcccgactgctgtcgcagaagacgtgttcctgccgtctctacgaa
ctgttgcacggagctggcaaccacgctgcgggtatcctgactctgggaaa
gcggcggcctggacctccaggcctccagggacggctgcagcgcctccttc
aggccaacgtaaccacgcagctggcatcctgaccat<u>gggccgccgc</u>aag
cccaccgagaacaacgaagacttcaacatcgtggccgtggccagcaactt
cgcgaccacggatctcgatgctgaccgcgggaagttgcccggcaagaagc
tgccgctggaggtgctcaaagagatggaagccaatgcccggaaagctggc
tgcaccagggctgtctgatctgcctgtcccacatcaagtgcacgccaa
gatgaagaagttcatcccaggacgctgccacacctacgaaggcgacaaag
agtccgcacagggcggcataggcgaggcgatcgtcgacattcctgagatt
cctggggttcaaggacttggagcccatggagcagttcatcgcacaggtcga
tctgtgtgtggactgcacaactggctgcctcaaagggcttgccaacgtgc
agtgttctgacctgctcaagaagtggctgccgccaacgctgtgcgaccttt
gccagcaagatccagggccaggtggacaagatcaaggggccggtggtga
c<u>ggccgccgc</u>gcaggcgcagagctagagccacatccctgctctggtcgcg
gctgtccgaccgtaactaccaccgctttagcaccccggggagggtccgga
gtctga Orexin Human (nucleic acid sequence):
(SEQ ID NO: 176)
Atgaaccttccttccacaaaggtctcctgggccgccgtgacgctactgct
gctgctgctgctgccgcccgcgctgttgtcgtccggggcggctgcac
agcccctgcccgactgctgtcgtcaaaagacttgctcttgccgctctac
gagctgctgcacgcgcgggcaatcacgcggccggcatcctcacgctggg
caagcggaggtccgggccccgggcctccaggggtcggctgcagcgcctcc
tgcaggccagcggcaaccacgccgcgggcatcctgaccatgggccgccgc
aagcccaccgagaacaacgaagacttcaacatcgtcggccgtggccagcaa
cttcgcgaccacgggatctcgatgctgaccgcgggaagttgcccggcaaga
agctgccgctggaggtgctcaaagagatggaagcaatgcccggaaagct
ggctgcaccaggggctgtctgatctgcctgtcccacatcaagtgcacgcc
caagatgaagaagttcatcccaggacgctgccacacctacgaaggcgaca
aagagtccgcacagggcggcataggcgaggcgatcgtcgacattcctgag
attcctgggttcaaggacttggagcccatggagcagttcatcgcacaggt
cgatctgtgtgtggactgcacaactggctgcctcaaagggcttgccaacg
tgcagtgttctgacctgctcaagaagtggctgccgcaacgctgtgcgacc
tttgccagcaagatccagggccaggtggacaagatcaagggggccggtggg
tgacggccgccgcgcaggcgcagagccagccgccgcccctgcctcgggc
gccgctgttccgccccggccgccgcctccgtcgcgcccggaggacagtcc
gggatctga Ghrelin-Obestatin Mouse (nucleic acid sequence):
(SEQ ID NO: 177)
Atgctgtcttcaggcaccatctgcagtttgctgctactcagcatgctctg
gatggacatggccatggcaggctccagcttcctgagcccagagccaccaga
aagcccagcagagaaaggaatccaagaagccaccagctgaaactgcagcca
cgagctaagcccaccgagaacaacgaagacttcaacatcgtggccgtggc
cagcaacttcgcgaccacggatctcgatgctgaccgcgggaagttgcccg
gcaagaagctgccgctggaggtgctcaaagagatggaagccaatgcccgga
aagctggctgcaccaggggctgtctgatctgcctgtcccacatcaagtg
cacgcccaagatgaagaagttcatcccaggacgctgccacacctacgaag
gcgacaaagagtccgcacagggcggcataggcgaggcgatcgtcgacatt
cctgagattcctgggttcaaggacttggagcccatggagcagttcatcgc
acaggtcgatctgtgtgtggactgcacaactggctgcctcaaagggcttg
ccaacgtgcagtgttctgacctgctcaagaagtggctgccgcaacgctgt
gcgacctttgccagcaagatccagggccaggtggacaagatcaagggggc
cggtggtgaccccacgagctctggaaggctggctccacccagaggacagag
gacaagcagaagagacagaggaggctggagatcaggttcaatgctccc
ttcgatgttggcatcaagctgtcaggagctcagtcatcagcagcatgccg
ggccctggggaagtttcttcaggatatcctctgggaagaggtcaaagagg
cgccagctgacaagtaa Ghrelin-Obestatin Human (nucleic acid sequence):
(SEQ ID NO: 178)
Atgccctccccagggaccgtctgcagcctcctgctcctcggcatgctctg
gctggactggccatggcaggctccagcttcctgagcccgaacaccaga
gagtccagagaaaggagtcgaagaagccaccagccaagctgcagccccga
gctaagcccaccgagaacaacgaagacttcaacatcgtggccgtggccag
caacttcgcgaccacggatctcgatgctgaccgcgggaagttgcccggca
agaagctgccgctggaggtgctcaaagagatggaagccaatgcccggaaa
gctggctgcaccaggggctgtctgatctgcctgtcccacatcaagtgcac
gcccaagatgaagaagttcatcccaggacgctgccacacctacgaaggcg
acaaagagtccgcacagggcggcataggcgaggcgatcgtcgacattcct
gagattcctgggttcaaggacttggagcccatggagcagttcatcgcaca
ggtcgatctgtgtgtggactgcacaactggctgcctcaaagggcttgcca
acgtgcagtgttctgacctgctcaagaagtggctgccgcaacgctgtgcg
acctttgccagcaagatccagggccaggtggacaagatcaaggggccggt
ggtgaccccccagctctagcaggctggctccgcccggaagatggaggtc
aagcaaaggggcagaggatgaactggaagtccggttcaacgccccctt
gatgttggaatcaagctgtcagggggttcagtaccagcagcacagccaggc
cctggggaagtttcttcaggacatcctctgggaagaggccaaagaggccc
cagccgacaagtga Cholecystokinin Mouse (nucleic acid sequence):
(SEQ ID NO: 179)
Atgaagagcggcgtatgtctgtgcgtggtgatggcagtcctagctgctgg
cgccctggccgcagccggtagtcctgcagaagctacggaccccgtggagc
agcgggccaagaggcgcccccgaaggcagctgcgggctaagcccaccgag
aacaacgaagacttcaacatcgtggccgtggccagcaacttcgcgaccac
ggatctcgatgctgaccgcgggaagttgcccggcaagaagctgccgctgg
aggtgctcaaagagatggaagccaatgcccggaaagctggctgcaccagg
ggctgtctgatctgcctgtcccacatcaagtgcacgcccaagatgaagaa
gttcatcccaggacgctgccacacctacgaaggcgacaaagagtccgcac
agggcggcataggcgaggcgatcgtcgacattcctgagattcctgggttc
aaggacttggagcccatggagcagttcatcgcacaggtcgatctgtgtgt
ggactgcacaactggctgcctcaaagggcttgccaacgtgcagtgttctg
acctgctcaagaagtggctgccgcaacgctgtgcgacctttgccagcaag
atccagggccaggtggacaagatcaaggggccggtggtgaccgaaggca
gctgcgggctgtgctccggacggacggcgagccccgagcgcgcctgggcg
cactgctagcgcgatacatccagcaggtccgcaaagctccttctggccgc
atgtccgttcttaagaacctgcagagcctggaccccagccatagaataag
tgaccgggactacatgggctggatggattttggccggcgcagtgccgagg
actacgaataccccatcgtag Cholecystokinin Human (nucleic acid sequence):
(SEQ ID NO: 180)
atgaacagcggcgtgtgcctgtgcgtgctgatggcggtgctggcggctgg
cgccctgacgcagccggtgcctcccgcagatcccgcgggctcgggggctgc
agcgggcagaggaggcgccccgtaggcagctgagggtaaagcccaccgag
aacaacgaagacttcaacatcgtggccgtggccagcaacttcgcgaccac
ggatctcgatgctgaccgcgggaagttgcccggcaagaagctgccgctgg
aggtgctcaaagagatggaagccaatgcccggaaagctggctgcaccagg
ggctgtctgatctgcctgtcccacatcaagtgcacgcccaagatgaagaa
gttcatcccaggacgctgccacacctacgaaggcgacaaagagtccgcac
agggcggcataggcgaggcgatcgtcgacattcctgagattcctgggttc
aaggacttggagcccatggagcagttcatcgcacaggtcgatctgtgtgt
ggactgcacaactggctgcctcaaagggcttgccaacgtgcagtgttctg
acctgctcaagaagtggctgccgcaacgctgtgcgacctttgccagcaag
atccagggccaggtggacaagatcaaggggccggtggtgaccgtaggca
gctgagggtcgcagagaacgagtggccgagtcccgagcgcacctgggcg
ccctgctgcaagatacatccagcaggcccgaaagctccttctggacga
atgtccatcgttaagaacctgcagaacctggaccccagccacaggataag
tgaccgggactacatgggctggatggattttggccgtcgcagtgccgagg
agtatgagtaccccctcctag Gastrin Mouse (nucleic acid sequence):
(SEQ ID NO: 181)
Atgcctcgactgtgtgtgtacatgctggtcttagtgctggctctagctac
cttctcggaagcttcttggaagcccgctcccagctacaggatgcatcat
ctggaccagggaccaatgaggacctggaacagcgccagtcaacaagctg
ggctcagcctctcaccatcgaaggcagctggggcccagggtcctcaaca
cttcatagcagactcctccaagaagcagaggccacaaaagattggaggaagaa
aagaggctacggatggatggactttggccgccccagtaagcccaccgag
aacaacgaagacttcaacatcgtggccgtggccagcaacttcgcgaccac
ggatctcgatgctgaccgcgggaagttgcccggcaagaagctgccgctgg
aggtgctcaaagagatggaagccaatgcccggaaagctggctgcaccagg
ggctgtctgatctgcctgtcccacatcaagtgcacgcccaagatgaagaa
gttcatcccaggacgctgccacacctacgaaggcgacaaagagtccgcac
agggcggcataggcgaggcgatcgtcgacattcctgagattcctgggttc
aaggacttggagcccatggagcagttcatcgcacaggtcgatctgtgtgt
ggactgcacaactggctgcctcaaagggcttgccaacgtgcagtgttctg
acctgctcaagaagtggctgccgcaacgctgtgcgacctttgccagcaag
atccagggccaggtggacaagatcaaggggccggtggtgaccgccgcag
tgctgaggaagaccagtag Gastrin Human (nucleic acid sequence):
(SEQ ID NO: 182)
Atgcagcgactatgtgtgtatgtgctgatctttgcactggctctggccgc
cttctctgaagcttcttggaagcccgctcccagcagccagatgcaccct
taggtacaggggccaacagggacctggagctaccctggctggagcagcag
ggcccagcctctcatcatcgaaggcagctgggacccagggtccccccaca
cctcgtggcagacccgtccaagaagcagggaccatggctggaggaagaag
aagaagcctatggatggatggactttggccgccccagtaagcccaccgag
aacaacgaagacttcaacatcgtggccgtggccagcaacttcgcgaccac
ggatctcgatgctgaccgcgggaagttgcccggcaagaagctgccgctgg
aggtgctcaaagagatggaagccaatgcccggaaagctggctgcaccagg
ggctgtctgatctgcctgtcccacatcaagtgcacgcccaagatgaagaa
gttcatcccaggacgctgccacacctacgaaggcgacaaagagtccgcac
agggcggcataggcgaggcgatcgtcgacattcctgagattcctgggttc
aaggacttggagcccatggagcagttcatcgcacaggtcgatctgtgtgt
ggactgcacaactggctgcctcaaagggcttgccaacgtgcagtgttctg
acctgctcaagaagtggctgccgcaacgctgtgcgacctttgccagcaag
atccagggccaggtggacaagatcaaggggccggtggtgaccgccgcag
tgctgaggatgagaactaa Protachykinin-1 (Substance P, Neurokinin A,
Neuropeptide K, Neuropeptide gamma) Mouse (nucleic
acid sequence):
(SEQ ID NO: 183)
atgaaaatcctcgtggccgtggcggtctttttctcgtttccactcaact
gtttgcagaggaaatcgatgccaacgatgatctaaattattggtccgact
ggtccgacagtcagcagatcaaggaggcaatgccggagcctttgagcat
cttctgcagaatgcccgaagaaagcccaccgagaacaacgaagacttc
aacatcgtggccgtggccagcaacttcgcgaccacggatctcgatgctg
accgcgggaagttgcccggcaagaagctgccgctggaggtgctcaaagag
atggaagccaatgcccggaaagctggctgcaccaggggctgtctgatctg
cctgtcccacatcaagtgcacgcccaagatgaagaagttcatcccaggac gctgccacacctacgaaggcgacaaagagtccgcacagggcggcataggc
gaggcgatcgtcgacattcctgagattcctgggttcaaggacttggagcc
catggagcagttcatcgcacaggtcgatctgtgtgtggactgcacaactg
gctgcctcaaagggcttgccaacgtgcagtgttctgacctgctcaagaag
tggctgccgcaacgctgtgcgacctttgccagcaagatccagggccaggt
ggacaagatcaagggggccggtggtgacc<u>cgaaga</u>cccaagcctcagcagt
tctttggattaatgggcaagcgggatgctgattcctcagttgaaaaacaa
gtggccctgttaaaggctctttatggacatggccagatctctcacaaaag
gcataaaacagattcctttgttggactaatgggcaaaagagctttaaatt
ctgtggcttatgaaagaagcgcgatgcagaactacgaaagaagacgtaaa
taa Protachykinin-1 (Substance P, Neurokinin A,
Neuropeptide K, Neuropeptide gamma) Human (nucleic
acid sequence):
(SEQ ID NO: 184)
atgaaaatcctcgtggccttggcagtcttttttcttgtctccactcagct
gtttgcagaagaaataggagccaatgatgatctgaattactggtccgact
ggtacgacagcgaccagatcaaggaggaactgccggagccctttgagcat
cttctgcagagaatcgcc<u>cggaga</u>aagcccaccgagaacaacgaagactt
caacatcgtggccgtggccagcaacttcgcgaccacggatctcgatgctg
accgcgggaagttgcccggcaagactgccgctggaggtgctcaaagag
atggaagccaatgcccggaaagctggctgcaccaggggctgtctgatctg
cctgtcccacatcaagtgcacgccaagatgaagaagttcatcccaggac
gctgccacacctacgaaggcgacaaagagtccgcacagggcggcataggc
gaggcgatcgtcgacattcctgagattcctgggttcaaggacttggagcc
catggagcagttcatcgcacaggtcgatctgtgtgtggactgcacaactg
gctgcctcaaagggcttgccaacgtgcagtgttctgacctgctcaagaag
tggctgccgcaacgctgtgcgacctttgccagcaagatccagggccaggt
ggacaagatcaagggggccggtggtgacc<u>cggaga</u>cccaagcctcagcagt
tctttggattaatgggcaaacgggatgctgattcctcaattgaaaaacaa
gtggccctgttaaaggctctttatggacatggccagatctctcacaaaag
acataaaacagattcctttgttggactaatgggcaaaagagctttaaatt
ctgtggcttatgaaaggagtgcaatgcagaattatgaaagaagacgttaa Proenkephalin-A Mouse (nucleic acid sequence):
(SEQ ID NO: 185)
atggcgcggttcctgaggcctttgcacctggctgctgctggcgcttgggtcctg
cctcctggctcacagtgcaggcggaatgcagccaggactgcgctaaatgca
gctaccgcctggttcgcccaggcgacatcaatttcctggcgtgcacactg
aatgtgaaggacagctgccttcttcaaaatctgggagacctgcaagga
tctcctgcaggtgtccaggcccgagttcccttgggataacatcgacatgt
acaaagacagcacgcaaacaggatgcagccacttgctagctgcaagaagtac
ggaggcttcatgaaacggtacgaggcttcatgaagaagatggacgagct
atatcccatggagccagaagaaggcgaacggaggagagatccttgcca
agaggtatggcggcttcatgaagaaggatgcagatgagggagacaccttg
gccaactcctccgatctgctgaaagagcctgggaacgggagacaaccg
tgcgaaagacagccaccaacaagagagcaccaacaatgacgaagacatga
gcaagaggtatggggggcttcatgaaagcctcaaaagaagccccaactg
gaagatgaagcaaaagagctgcagaagcgctacggggcttcat<u>agaag</u>
<u>gaag</u>cccaccgagaacaacgaagacttcaacatcgtggccgtggccag
acttcgcgaccacggatctcgatgctgaccgcggggaagttgcccggcaag
aagctgccgctggaggtgctcaaagagatggaagccaatgcccgaaagc
tggctgcaccaggggctgtctgatctgcctgtcccacatcaagtgcacg
ccaagatgaagaagttcatcccagacgctgccacacctacgaaggcgac
aaagagtccgcacagggcggcataggcgaggcgatcgtcgacattcctga
gattcctgggttcaaggacttggagcccatggagcagttcatcgcacagg
tcgatctgtgtgtggactgcacaactggctgcctcaaagggcttgccaac
gtgcagtgttctgacctgctcaagaaggctgccgcaacgctgtgcgacc
ctttgccagcaagatccagggccaggtggacaagatcaagggggccggtg
gtgac<u>agaaggg</u>tgggacgccccgagtggtggatggactaccagaagagg
tatggggggcttcctgaagcgctttgctgagtctctgccctccgatgaaga
aggcgaaaattactcgaaagaagttcctgagatagagaaagatacgggg
gctttatgcggttctga Proenkephalin-A Human (nucleic acid sequence):
(SEQ ID NO: 186)
atggcgcgcttcctgacactttgcacttggctgctgttgctcggccccgg
gctcctggcgaccgtgcgggccgaatgcagccaggattgcgacgtgca
gctaccgcctagtgcgcccggccgacatcaacttcctggcttcgtaatg
gaatgtgaaggtaaactgccttctctgaaaatttgggaaacctgcaagga
gctcctgcagctgtccaaaccagagcttcctcaagatggcaccagcaccc
tcagagaaaatagcaaaccggaagaaagcatttgctagccaaaaggtat
gggggcttcatgaaaaggtatcatgaagaaatggatgagct
ttatcccatggagccagaagaagaggccaatggaagtgagatcctcgcca
agcggtatgggggcttcatgaagaaggatgcagaggaggacgactcgctg
gccaattcctcagacctgctaaaagagcttctggaaacaggggacaaccg
agagcgtagccaccaccaggatggcagtgataatgaggaagaagtgagca
agagatatggggggcttcatgagagggcttaaagagaagccccaactgaa
gatgaagccaaagagctgcagaagcgatatgggggcttcat<u>gagaagaa</u>
<u>gcc</u>caccgagaacaacgaagacttcaacatcgtggccgtggccagcaact
tcgcgaccacggatctcgatgctgaccgcgggaagttgcccggcaagaag
ctgccgctggaggtgctcaaagagatggaagccaatgcccggaaagctgg
ctgcaccaggggctgtctgatctgcctgtcccacatcaagtgcacgccca
agatgaagaagttcatcccagacgctgccacacctacgaaggcgacaaa
gagtccgcacagggcggcataggcgaggcgatcgtcgacattcctgagat
tcctgggttcaaggacttggagcccatggagcagttcatcgcacaggtcg
atctgtgtgtggactgcacaactggctgcctcaaagggcttgccaacgtg
cagtgttctgacctgctcaagaagtggctgccgcaacgctgtgcgaccttt
gccagcaagatccagggccaggtggacaagatcaagggggccggtggtg
ac<u>agaagt</u>aggtcgcccagagtggtggatggactaccagaaacggtat
ggaggtttcctgaagcgctttgccgaggctctgccctccgacgaagagg
cgaaagttactccaaagaagttcctgaaatgaaaaaagatacggaggat
ttatgagatttttaa Proenkephalin-B Mouse (nucleic acid sequence):
(SEQ ID NO: 187)
atggcgtggtccaggctgatgctggcagcttgcctcctcgtgatgccctc
taatgttatggcggactgcctgtccctgtgctccctgtgtgcagtgagga
ttcaggatgggccccgtcccatcaaccccctgatttgctccctggagtgc
caggacctggtgccgccctcagaggagtgggagacatgccggggcttctc
atcttttctcacccctgacggtctctctgggctccgtgcaaggatgacttgg
aagatgaggttgctttggaagaaggctacagtgcactagccaagtcttg
gaacccgtcctgaaggagctggagaaaagccgactccttaccagcgtccc
agaggaaaagttcagggtctctccagcagcttttggcaacggaaagaat
ctgagctggcgggtgctgaccggatgaatgatgaagccgcacaggcggc
acgctccatttttaatgaggaggacttgagaaaacaggccaaacgctatgg
cggcttttttgcgcaaataccccc<u>aagagg</u>aagcccaccgagaacaacgaag
acttcaacatcgtggccgtggccagcaacttcgcgaccacggatctcgat
gctgaccgcgggaagttgcccggcaagaagctgccgctggaggtgctcaa
agagatggaagccaatgcccggaaagctggctgcaccaggggctgtctga
tctgcctgtcccacatcaagtgcacgcccaagatgaagaagttcatccca
ggacgctgccacacctacgaaggcgacaaagagtccgcacagggcggcat
aggcgaggcgatcgtcgacattcctgagattcctgggttcaaggacttgg
agcccatggagcagttcatcgcacaggtcgatctgtgtgtggactgcaca
actggctgcctcaaagggcttgccaacgtgcagtgttctgacctgctcaa
gaagtggctgccgcaacgctgtgcgacctttgccagcaagatccagggcc
aggtggacaagat<u>caagggg</u>ccggtggtgaca<u>aaacgct</u>atggggctttttgcgc
gccggdgatgaggacggggccaggatggggatcaggtagggcatgagga
cctgtacaaacgctatgggggcttcctgcgggcgcattcgccccaagctga
agtgggacaaccagaagcgctatggtggtttcctgcggcgtcagttcaag
gtggtgacgcggtcccaggagaaccccaatacctattctgaagatttaga
tgtttga Proenkephalin-B Human (nucleic acid sequence):
(SEQ ID NO: 188)
atggcctggcaggggctggtcctggctgcctgcctcctcatgttccctc
caccacagcggactgcctgtcgcggtgctccttgtgtgctgtaaagaccc
aggatggtcccaaacctatcaatcccctgatttgctccctgcaatgccag
gctgcctctgccctctgaggaatgggaagagatgccagagcttctgtc
tttttttcaccccctccaccctttgggctcaatgacaaggaggacttgggga
gcaagtcggttgggaagggccctacagtgagctggccaagtctctctggg
tcattcctgaaggagctggagaaaagcaagtttctcccaagtatctcaac
aaaggagaacactctgagcaagagcctggaggagaagctcagggttctct
ctgacggttttaggagggagcagatctgagctgatgagggatgcccag
ctgaacgatggtgccatggagactggcacactctatctcgctgaggagga
ccccaaggagcaggt<u>caaacgc</u>aagcccaccgagaacaacgaagacttca
acatcgtggccgtggccagcaacttcgcgaccacggatctcgatgctgac
cgcgggaagttgcccggcaagaagctgccgctggaggtgctcaaagagat
ggaagccaatgcccggaaagctggctgcaccaggggctgtctgatctgcc
tgtcccacatcaagtgcacgcccaagatgaagaagttcatcccaggacgc
tgccacacctacgaaggcgacaaagagtccgcacagggcggcataggcga
ggcgatcgtcgacattcctgagattcctgggttcaaggacttggagccca
tggagcagttcatcgcacaggtcgatctgtgtgtggactgcacaactggc
tgcctcaaagggcttgccaacgtgcagtgttctgacctgctcaagaagtg
gctgccgcaacgctgtgcgacctttgccagcaagatccagggccaggtgg
acaagatcaagggggccggtggtgaca<u>aaacgct</u>atgggggcttttttgcgc
aaatacccccaagaggaagctcagaggtggctggggagggaacgggatag
catgggccatgaggacctgtacaaacgctatgggggcttcctgcgggcga
ttcgtcccaagctcaagtgggacaaccagaagcgctatggcggttttctc
cggcgccagttcaaggtggtgactcggtctcaggaagatccgaatgctta
ctctggagagcttttgatgcataa Insulin-like growth hormone 1 (IGF-1) Mouse
(nucleic acid sequence):
(SEQ ID NO: 189)
atggggaaaatcagcagccttccaactcaattatttaagatctgcctctg
tgacttcttgaagataaagatacacatcatgtcgtcttcacacctcttct acctggcgctctgcttgctcaccttcaccagctccaccacagctggacca
gagacccttgcggggctgagctggtggatgctcttcagttcgtgtgtgg
accgaggggcttttacttcaacaagcccacaggctatggc<u>tccagcattc
ggagg</u>aagcccaccgagaacaacgaagacttcaacatcgtggccgtggcc
agcaacttcgcgaccacggatctcgatgctgaccgcgggaagttgcccg
caagaagctgccgctggaggtgctcaaagagatggaagccaatgcccgga
aagctggctgcaccaggggctgtctgatctgcctgtcccacatcaagtgc
acgcccaagatgaagaagttcatcccaggacgctgccacacctacgaagg
cgacaaagagtccgcacagggcggcataggcgaggcgatcgtcgacattc
ctgagattcctggttcaaggacttgggagcccatggagcagttcatcgca
caggtcgatctgtgtgtggactgcacaactggctgcctcaaagggcttgc
caacgtgcagtgttctgacctgctcaagaagtggctgccgcaacgctgtg
cgacctttgccagcaagatccagggccaggtggacaagatcaaggggccc
ggtggtgac<u>tccagcattcggagg</u>gcacctcagacaggcattgtggatga
gtgttgcttccggagctgtgatctgaggagactggagatgtactgtgccc
cactgaagcctacaaaagcagcccgctctatccgtgcccagcgccacact
gacatgcccaagactcagaagtcccgtccctatcgacaaacaagaaaac
gaagctgcaaaggagaaggaaaggaagtacatttgaagaacacaagtag Insulin-like growth hormone 1 (IGF-1) Human
(nucleic acid sequence):
(SEQ ID NO: 190)
atgggaaaaatcagcagtcttccaacccaattattttaagtgctgcttttg
tgatttcttgaaggtgaagatgcacaccatgtctcctcgcatctcttcta
cctgcgctgtgcctgctcaccttcaccagctctgccacggctggaccgg
agacgctctgcggggctgagctggtggatgctcttcagttcgtgtgtgga
gacaggggcttttatttcaacaagcccacagggtatggct<u>agcagtcg
gagg</u>aagcccaccgagaacaacgaagacttcaacatcgtggccgtggca
gcaacttcgcgaccacggatctcgatgctgaccgcgggaagttgcccggc
aagaagctgccgctggaggtgctcaaagagatggaagccaatgcccggaa
agctggctgcaccaggggctgtctgatctgcctgtcccacatcaagtgca
cgcccaagatgaagaagttcatcccaggacgctgccacacctacgaaggc
gacaaagagtccgcacagggcggcataggcgaggcgatcgtcgacattcc
tgagattcctggttcaaggacttgggagcccatggagcagttcatcgcac
aggtcgatctgtgtgtggactgcacaactggctgcctcaaagggcttgcc
aacgtgcagtgttctgatctgctcaagaagtggctgccgcaacgctgtgc
gacctttgccagcaagatccagggccaggtggacaagatcaaggggccgg
tggtgac<u>agcagtcggaggg</u>cgcctcagacaggcatcgtggatgagtgc
tgcttccggagctgtgatctaaggaggctggagattgtattgcgcaccct
caagcctgccaagtcagctcgctctgtccgtgcccagcgccacaccgaca
tgcccaagacccagaagtatcagccccatctaccaacaagaacacgaag
tctcagagaaggaaaggaagtacatttgaagaacgcaagtag Insulin-like growth hormone 2 (IGF-2) Mouse
(nucleic acid sequence):
(SEQ ID NO: 191)
atgggcggcagcgtcgccggcttccaggtaccaatgggaatcccagtggg
gaagtcgatgttggtgcttctcatctcttttggccttcgccttgtgctgca
tcgctgctctaccggccccggagagactctgtgcggaggggagctgttgac
acgcttcagtttgtctgttcggaccgcggcttctacttcagcaggccttc
aagccgtgccaacgtgccagccgtgccatcgtggaaggcttgtcttcc
gcagtcgcgacctggccctcctggagacatactgtgccaccccgccaag
tccg<u>agagggac</u>aagcccaccgagaacaacgaagacttcaacatcgtggc
cgtggccagcaacttcgcgaccacggatctcgatgctgaccgcgggaagt
tgcccggcaagaagctgccgctggaggtgctcaaagagatggaagccaat
gcccggaaagctggctgcaccaggggctgtctgatctgcctgtcccacat
caagtgcacgcccaagatgaagaagttcatcccaggacgctgccacacct
acgaaggcgacaaagagtccgcacagggcggcataggcgaggcgatcgtc
gacattcctgagattcctggttcaaggacttgggagcccatggagcagtt
catcgcacaggtcgatctgtgtgtggactgcacaactggctgcctcaaag
ggcttgccaacgtgcagtgttctgacctgctcaagaagtggctgccgcaa
cgctgtgcgacctttgccagcaagatccagggccaggtggacaagatcaa
ggggccggtggtgac<u>gagagggac</u>gtgtctacctctcaggccgtacttc
cggacgacttcccagatacccgtgggcaagttcttccaagatacacc
tggacagtccgcgggacgctcgcagagcctgcctgccctcctgcg
tgcccgccggggtcgcatgcttgccaaagagctcaaagagttcagagagg
ccaaacgtcatcgtccctgatcgtgttaccaccccaaagaccccgcccac
gggggagcctcttcggagatgtccagcaaccatcagtga Insulin-like growth hormone 2 (IGF-2) Human
(nucleic acid sequence):
(SEQ ID NO: 192)
atgggaatcccaatggggaagtcgatgctggtgcttctcaccttcttggc
cttcgctcgtgctgcattgctgcttaccgcccagtgagacccgtgcg
gcgggagctggtggacaccctccagttcgtctgtggggaccgcggcttc
tacttcagcaggcccaagcgtgtgagccgtcgcagccgtggcatcgt
tgaggagtgctgtttccgcagctgtgacctggccctcctggagacgtact
gtgctaccccgccaagtc<u>gagagggac</u>aagcccaccgagaacaacgaa
gacttcaacatcgtggccgtggccagcaacttcgcgaccacggatctcga
tgctgaccgcggggaagttgcccggcaagaagctgccgctggaggtgctca
aagagatggaagccaatgcccggaaagctggctgcaccaggggctgtctg
atctgcctgtcccacatcaagtgcacgcccaagatgaagaagttcatccc
aggacgctgccacacctacgaaggcgacaaagagtccgcacagggcggca
taggcgaggcgatcgtcgacattcctgagattcctggttcaaggacttg
gagcccatggagcagttcatcgcacaggtcgatctgtgtgtggactgcac
aactggctgcctcaaagggcttgccaacgctgtgcgaccttgccagcaagatccagggc
caggtggacaagatcaaggggccggtggtgac<u>gagagggac</u>gtgtcgac
ccctcgaccgtgcttccggacaacttcccccagatacccgtgggcaagt
tcttccaatatgacaacctggaagcagtccacccagcgcctgcgcagggg
ctgcctgccctcctgcgtgcccgccggggtcacgtgctcgcaaggagct
cgaggcgttcagggaggccaaacgtcaccgtccctgatctgcactccca
cccaagaccccgcccacggggcgccccccccagagatggccagcaatcgg
aagtga Parathyroid hormone (PTH) Mouse (nucleic acid
sequence):
(SEQ ID NO: 193)
atgatgtctgcaaacaccgtggctaaagtgatgatcatcatgctggcagt
ctgtcttcttacccaaacggatgggaaacccgtgagg<u>aagagaa</u>agccca
ccgagaacaacgaagacttcaacatcgtggccgtggccagcaacttcgcg
accacggatctcgatgctgaccgcgggaagttgcccggcaagaagctgcc
gctggaggtgctcaaagagatggaagccaatgcccggaaagctggctgca
ccaggggctgtctgatctgcctgtcccacatcaagtgcacgcccaagatg
aagaagttcatcccaggacgctgccacacctacgaaggcgacaaagagtc
cgcacagggcggcataggcgaggcgatcgtcgacattcctgagattcctg
gttcaaggacttggagcccatggagcagttcatcgcacaggtcgatctg
tgtgtggactgcacaactggctgcctcaaagggcttgccaacgtgcagtg
ttctgacctgctcaagaagtggctgccgcaacgctgtgcgacctttgcca
gcaagatccagggccaggtggacaagatcaaggggccggtggtgac<u>aag
agag</u>ctgtcagtgaaatacagcttatgcacaacctgggcaaacacctggc
ctccatggagaggatgcaatggctgagaaggaagctgcaagatatgcaca
attttgttagtcttggagtccaaatggctgccagagatggcagtcaccag
aagcccaccaagaaggaggaaaatgtccttgttgatggcaatccaaaaag
tcttggtgagggagacaaagctgatgtggatgtattagttaaatcaaaat
ctcagtaa Parathyroid hormone (PTH) Human (nucleic acid
sequence):
(SEQ ID NO: 194)
atgatacctgcaaaagacatggctaaagttatgattgtcatgttggcaat
ttgttttctacaaaatcggatgggaaatctgttaa<u>gaagagaa</u>agccca
ccgagaacaacgaagacttcaacatcgtggccgtggccagcaacttcgcg
accacggatctcgatgctgaccgcgggaagttgcccggcaagaagctgcc
gctggaggtgctcaaagagatggaagccaatgcccggaaagctggctgca
ccaggggctgtctgatctgcctgtcccacatcaagtgcacgcccaagatg
aagaagttcatcccaggacgctgccacacctacgaaggcgacaaagagtc
cgcacagggcggcataggcgaggcgatcgtcgacattcctgagattcctg
gttcaaggacttggagcccatggagcagttcatcgcacaggtcgatctg
tgtgtggactgcacaactggctgcctcaaagggcttgccaacgtgcagtg
ttctgacctgctcaagaagtggctgccgcaacgctgtgcgacctttgcca
gcaagatccagggccaggtggacaagatcaaggggccggtggtgac<u>aag
agat</u>ctgtgagtgaaatacagcttatgcataacctgggaaaacatctgaa
ctcgatggagaagaggaatgctgctaagcaagctgcaggatgtgcaa
attttgttgccctggagctcctctagctcccagagatgctggttcccag
aggccccgaaaaaggaagacaatgtcttggttgagagccatgaaaaaag
tcttggagaggcagacaaagctgatgtgaatgtattaactaaagctaaat
cccagtga Parathyroid hormone-related protein (PTHrP) Mouse
(nucleic acid sequence):
(SEQ ID NO: 195)
atgctgcggaggctggttcagcagtggagtgtcctggtgattcctgctcag
ctactccgtgcctcccgcgggcgttcggtggagggctttggccgcaggc
tc<u>aaacgc</u>aagccccaccgagaacaacgaagacttcaacatcgtggccgtg
gccagcaacttcgcgaccacggatctcgatgctgaccgcgggaagttgcc
cggcaagaagctgccgctggaggtgctcaaagagatggaagccaatgccc
ggaaagctggctgcaccaggggctgtctgatctgcctgtcccacatcaag
tgcacgcccaagatgaagaagttcatcccaggacgctgccacacctacga
aggcgacaaagagtccgcacagggcggcataggcgaggcgatcgtcgaca
ttcctgagattcctggttcaaggacttggagcccatggagcagttcatc
gcacaggtcgatctgtgtgtggactgcacaactggctgcctcaaagggct
tgccaacgtgcagtgttctgacctgctcaagaagtggctgccgcaacgct
gtgcgacctttgccagcaagatccagggccaggtggacaagatcaagggg
ccggtggtgac<u>aaacgc</u>gctgtgtctgaacatcagctactgcatgacaa
gggcaagtccatccaagacttgcgccgcgtttcttcctccaccatctga
tcgcggagatccacacagccgaaatcagagctacctcggaggtgtccccc
aactccaaacctgctcccaacaccaaaaaccaccccgtgcggtttgggtc -continued agacgatgagggcagatacctaactcaggaaaccaacaaggtggagacgt
acaaagaacagccactcaagacacccgggaagaagaagaaaggcaagcct
gggaaacgcagagaacaggagaaaaagaagcgaaggactcggtctgcctg
gccaagcacagctgcgagtggcctgcttgaggaccccctgccccacacct
ccaggccctcgctggagcccagcttaaggacgcattga Parathyroid hormone-related protein (FTHrP) Human
(nucleic acid sequence):
(SEQ ID NO: 196)
atgcagcggagactggttcagcagtggagcgtcgcggtgttcctgctgag
ctacgcggtgccctcctgcgggcgctcggtggagggtctcagccgccgcc
tc<u>aaaaga</u>aagccaccgagaacaacgaagacttcaacatcgtggccgtg
gccagcaacttcgcgaccacggatctcgatgctgaccgcgggaagttgcc
cggcaagaagctgccgctggaggtgctcaaagagatggaagccaatgcc
ggaaagctggctgcaccaggggctgtctgatctgcctgtcccacatcaag
tgcacgcccaagatgaagaagttcatcccaggacgctgccacacctacga
aggcgacaaagagtccgcacagggcggcataggcgaggcgatcgtcgaca
ttcctgagattcctgggttcaaggacttggagcccatggagcagttcatc
gcacaggtcgatctgtgtgtggactgcacaactggctgcctcaaagggct
tgccaacgtgcagtgttctgacctgctcaagaagtggctgccgcaacgct
gtgcgacctttgccagcaagatccagggccaggtggacaagatcaagggg
gccggtggtgac<u>aaaaga</u>ctgtgtctgaacatcagctcctccatgacaa
ggggaagtccatccaagattacgtgcgacgattcttccttcaccatctga
tcgcagaaatccacacagctgaaatcagagctacctcggaggtgtcccct
aactccaagccctctcccaacacaaagaaccaccccgtccgatttgggtc
tgatgatgagggcagatacctaactcaggaaaccaacaaggtggagacgt
acaaagaacagccgctcaagacacctgggaagaaaaagaaaggcaagccc
gggaaacgcaaggagcaggaaaagaaaaaacggcgaactcgctctgcctg
gttagactctggagtgactgggagtgggctagaaggggacacctgtctg
acacctccacaacgtcgctggagctcgattcacggaggcattga Osteocalcin Mouse (nucleic acid sequence):
(SEQ ID NO: 197)
atgaggaccatctttctgctcactctgctgaccctggctgcgctctgtct
ctctgacctcacagatgccaagcccagcggccctgagtctgacaaagcct
tcatgtccaagcaggagggcaataaggtagtgaacagact<u>ccggcgc</u>aag
cccaccgagaacaacgaagacttcaacatcgtggccgtggccagcaactt
cgcgaccacggatctcgatgctgaccgcgggaagttgcccggcaagaagc
tgccgctggaggtgctcaaagagatggaagccaatgcccggaaagctggc
tgcaccaggggctgtctgatctgcctgtcccacatcaagtgcacgcccaa
gatgaagaagttcatcccaggacgctgccacacctacgaaggcgacaaag
agtccgcacagggcggcataggcgaggcgatcgtcgacattcctgagatt
cctgggttcaaggacttggagcccatggagcagttcatcgcacaggtcga
tctgtgtgtggactgcacaactggctgcctcaaagggcttgccaacgtgc
agtgttctgacctgctcaagaagtggctgccgcaacgctgtgcgaccttt
gccagcaagatccagggccaggtggacaagatcaaggggggccggtggtga
<u>ccggcgc</u>tacctggagcctcagtccccagccccagacccctggagccca
ccggggagcagtgtgagcttaacctgcttgtgacgagctatcagaccag
tatggcttgaagaccgcctacaaacgcatctatggtatcactatttag Osteocalcin Human (nucleic acid sequence):
(SEQ ID NO: 198)
atgagagccctcacactcctcgcccattggccctggccgcacttttgcat
cgctggccaggcaggtgcgaagcccagcggtgcagagtccagcaaaggtg
cagccttttgtgtccaagcaggcagcgaggtagtgaagagacc<u>agg
cgc</u>aagcccaccgagaacaacgaagacttcaacatcgtggccgtggccag
caacttcgcgaccacggatctcgatgctgaccgcgggaagttgcccggca
agaagctgccgctggaggtgctcaaagagatggaagccaatgccggaaaa
gctggctgcaccaggggctgtctgatctgcctgtcccacatcaagtgcac
gcccaagatgaagaagttcatcccaggacgctgccacacctacgaaggcg
acaaagagtccgcacagggcggcataggcgaggcgatcgtcgacattcct
gagattcctgggttcaaggacttggagcccatggagcagttcatcgcaca
ggtcgatctgtgtgtggactgcacaactggctgcctcaaagggcttgcca
acgtgcagtgttctgacctgctcaagaagtggccgcaacgctgtgcg
acctttgccagcaagatccagggccaggtggacaagatcaaggggccgg
tggtgac<u>aggcgc</u>tacctgtatcaatggctgggagcccagtcccctacc
cggatcccctggagcccaggagggaggtgtgtgagctcaatccggactgt
gacgagtggctgaccacatcggctttcaggaggcctatcggcgcttcta
cggccccggtctag Urocortin-3 Mouse (nucleic acid sequence):
(SEQ ID NO: 199)
atgctgatgcccaccttacttcctgctgccacttctgctgctcctaggagg
tccaaggacaagcctctcccacaagttctacaaacactggaccagtcttca
gctgcctcaacacagcctatctgagctcaagaagaacaagctggaagat
gtgcccttgctgagcaagaagagctttggccacctgcccacacaagaccc
ctcaggggaagaagatgacaaccaaacgcacctccagatcaaaagaactt
tctcaggtgccgcgggtgggaatgagctgggagcacccggtacagatac
caatcccaggcacagcacaaggggaagctgtacccagacaagcccaaaag cgac<u>cggggcaccaag</u>aagcccaccgagaacaacgaagacttcaacatcg
tggccgtggccagcaacttcgcgaccacggatctcgatgctgaccgcggg
aagttgcccggcaagaagctgccgctggaggtgctcaaagagatggaagc
caatgcccggaaagctggctgcaccaggggctgtctgatctgcctgtccc
acatcaagtgcacgcccaagatgaagaagttcatcccaggacgctgccac
acctacgaaggcgacaaagagtccgcacagggcggcataggcgaggcgat
cgtcgacattcctgagattcctgggttcaaggacttggagcccatggagc
agttcatcgcacaggtcgatctgtgtgtggactgcacaactggctgcctc
aaagggcttgccaacgtgcagtgttctgacctgctcaagaagtggctgcc
gcaacgctgtgcgacctttgccagcaagatccagggccaggtggacaaga
tcaagggggccggtggtgac<u>cggggcaccaag</u>ttcacccttccccttgat
gttcccactaacatcatgaacatcctcttcaacatcgacaaggccaagaa
tttgcgagccaaggcagctgccaatgctcagctcatggcacagattggga
agaagaagtaa Urocortin-3 Human (nucleic acid sequence):
(SEQ ID NO: 200)
Atgctgatgccggtccacttcctgctgctcctgctgctgctcctgggggag
cccaggacaggcctccccacaagttctacaaagccaagcccatcttca
gctgcctcaacaccgccctgtctgaggctgagaaggccagtgggaggat
gcatccctgctgagcaagaggagcttccactacctgcgcagcagagacgc
ctcttcgggagaggaggagaggcgaagaagaaagacttcccatct
ctggggcagggtggagccagaggcaccggtacagatacgtgtcccaa
gcacagccaggggaaagccacgccaggacacgccaagagtcc<u>caccg</u>
<u>c</u>aagcccaccgagaacaacgaagacttcaacatcgtggccgtggccagca
acttcgcgaccacggatctcgatgctgaccgcgggaagttgcccggcaag
aagctgccgctggaggtgctcaaagagatggaagccaatgcccggaaagc
tggctgcaccaggggctgtctgatctgcctgtcccacatcaagtgcacgc
ccaagatgaagaagttcatcccaggacgctgccacacctacgaaggcgac
aaagagtccgcacagggcggcataggcgaggcgatcgtcgacattcctga
gattcctgggttcaaggacttggagcccatggagcagttcatcgcacagg
tcgatctgtgtgtggactgcacaactggctgcctcaaagggcttgccaac
gtgcagtgttctgacctgctcaagaagtggctgccgcaacgctgtgcgac
ctttgccagcaagatccagggccaggtggacaagatcaaggggggccggtg
gtgac<u>caccgc</u>accaagttcacccttccctcgacgtccccaccaacatc
atgaacctcctcttcaacatcgccaaggccaagaacctgcgtgcccaggc
ggccgcaatgcccacctgatggcgcaaattgggaggaagaagtag Urocortin-2 Mouse (nucleic acid sequence):
(SEQ ID NO: 201)
Atgatgaccaggtgggcactggtggtgttcgtggtcctgatgttggatag
gatcctatttgtcccaggaactcctatcccaccttccagctcctccctc
agaactctctgagacaactcctagctctgtgacctcagagagctctca
ggtaccaccacaggaccctcagcttcctggagcaactctaaagccagcc
ttacctagaca<u>acccgtgtc</u>aagcccaccgagaacaacgaagacttcaaca
tcgtggccgtggccagcaacttcgcgaccacggatctcgatgctgaccgc
gggaagttgcccggcaagaagctgccgctggaggtgctcaaagagatgga
agccaatgcccggaaagctggctgcaccaggggctgtctgatctgcctgt
cccacatcaagtgcacgcccaagatgaagaagttcatcccaggacgctgc
cacacctacgaaggcgacaaagagtccgcacagggcggcataggcgaggc
gatcgtcgacattcctgagattcctgggttcaaggacttggagcccatgg
agcagttcatcgcacttggtcgatctgtgtgtggactgcacaactggctg
cctcaaagggcttgccaacgtgcagtgttctgacctgctcaagaagtggc
tgccgcaacgctgtgcgacctttgccagcaagatccagggccaggtggac
aagatcaaggggggccggtggtgac<u>acccgtgt</u>catactctccctggatgt
tcccattggctcctacggatcttactggaacaggctcgttacaaggctg
ccaggaatcaggctgccaaatactagcccatgttggccgc
cgctga Urocortin-2 Human (nucleic acid sequence):
(SEQ ID NO: 202)
atgaccaggtgtgctctgctgttgctgatggtcctgatgttgggcagagt
cctggttgtcccagtgaccctatcccaaccttccagctccgccctcaga
attctccccagcaaccatccccgaccccgggcctcagagagcccctcagct
gctcccacatggccgtgggctgcccagggacactgcagcccccaccgcca
ccctggct<u>cgcgcatt</u>aagcccaccgagaacaacgaagacttcaacatcg
tggccgtggccagcaacttcgcgaccacggatctcgatgctgaccgcggg
aagttgcccggcaagaagctgccgctggaggtgctcaaagagatggaagc
caatgcccggaaagctggctgcaccaggggctgtctgatctgcctgtccc
acatcaagtgcacgcccaagatgaagaagttcatcccaggacgctgccac
acctacgaaggcgacaaagagtccgcacagggcggcataggcgaggcgat
cgtcgacattcctgagattcctgggttcaaggacttggagcccatggagc
agttcatcgcacaggtcgatctgtgtgtggactgcacaactggctgcctc
aaagggcttgccaacgtgcagtgttctgacctgctcaagaagtggctgcc
gcaacgctgtgcgacctttgccagcaagatccagggccaggtggacaag
atcaaggggggccggtggtgac<u>tcgcgcatt</u>gtcctatcgctggatgtccc
catcggcctcttgcagatcttactggagcaagcccgggccaggctgcca
gggagcaggccaccaccaacgcccgcatcctggcccgtgtcggccactgc
tga Urocortin-1 Mouse (nucleic acid sequence):
(SEQ ID NO: 203)
Atgatacagaggggacgcgctacgctcctggtggcgttgctgctcttggc
acagcttcgcccggagagcagccagtggagcccagcggctgcggcggca
ctggggtccaggatccgaatctgcgatggagccctggagtgcggaatcag
ggcggcggcgtccgcgcgctcctcttgctgttagcggagcgcttcccgcg
ccgcgcaggatctgagcctgcgggcgagcggcagcgacggaagcccaccg
agaacaacgaagacttcaacatcgtggccgtggccagcaacttcgcgacc
acggatctcgatgctgaccgcggggaagttgcccggcaagaagctgccgct
ggaggtgctcaaagagatggaagcaatgcccggaaagctggctgcacca
ggggctgtctgatctgcctgtcccacatcaagtgcacgcccaagatgaag
aagttcatcccaggacgctgccacacctacgaaggcgacaaagagtccgc
acagggcggcataggcgaggcgatcgtcgacattcctgagattcctgggt
tcaaggacttggagcccatggagcagttcatcgcacaggtcgatctgtgt
gtggactgcacaactggctgcctcaaagggcttgccaacgtgcagtgttc
tgacctgctcaagaagtggctgccgcaacgctgtgcgacctttgccagca
agatccagggccaggtggacaagatcaaggggggcggtggtgaccgacgg
gacgaccctccactgtccatcgacctcacctttccacctgctgcggaccct
gctggagctagctcggacacagagccagcgcgagcgcgcagagcagaacc
gcatcatattcgattcggtgggcaagtga Urocortin-1 Human (nucleic acid sequence):
(SEQ ID NO: 204)
atgaggcaggcgggacgcgcagcgctgctggccgcgctgctgctcctggt
acagcttgtgcccctgggagcagccagagagcccccgaggcggccgggtc
aggaccgagtctgcgctggagccccggggcacggaaccagggtggcgg
gcccgcgcgctcctcttgctgctggcggagcgcttcccgcgccgcgcggg
gcccggccgattgggactcgggacggcaggcgagcggccgcgacggaagc
ccaccgagaacaacgaagacttcaacatcgtggccgtggccagcaacttc
gcgaccacggatctcgatgctgaccgcggggaagttgcccggcaagaagct
gccgctggaggtgctcaaagagatggaagcaatgcccggaaagctggct
gcaccaggggctgtctgatctgcctgtcccacatcaagtgcacgcccaag
atgaagaagttcatcccaggacgctgccacacctacgaaggcgacaaaga
gtccgcacagggcggcataggcgaggcgatcgtcgacattcctgagattc
ctgggttcaaggacttggagcccatggagcagttcatcgcacaggtcgat
ctgtgtgtggactgcacaactggctgcctcaaagggcttgccaacgtgca
gtgttctgacctgctcaagaagtggctgccgcaacgctgtgcgacctttg
ccagcaagatccagggccaggtggacaagatcaaggggggcggtggtgac
cgcgggacaacccttctctgtccattgacctcacctttcacctgctgcg
gaccctgctggagctggcgcggacacagagccagcgggagcgcgccagc
agaaccgcatcatattcgactcggtgggcaagtga FGF23 Mouse (nucleic acid sequence):
(SEQ ID NO: 205)
Atgctagggacctgccttagactcctggtgggcgtgctctgcactgtctg
cagcttgggcactgctagactatccggacacttccccattgcttggcgt
ccaactggggaagcctgaccacctgtacacggctcacagccaggaccagc
tatcacctacagatccataggatggtcatgtagatggcaccccccatca
gaccatctacagtgccctgatgattacatcagaggacgccggctctgtgg
tgataacaggagccatgactcgaaggttccttttgtatggatctccacggc
aacattttggatcgcttcacttcagcccagagaattgcaagttccgcca
gtggacgctggagaatggctatgacgtctacttgtcgcagaagcatcact
acctggtgagcctgggccgcgccaagcgcatcttccagccgggcaccaac
ccgccgcccttctcccagttcctggctcgcaggaaggtcccgctgct
gcatttctacactgttcgcccacggcgccacacgcgcagcaagcccaccg
agaacaacgaagacttcaacatcgtggccgtggccagcaacttcgcgacc
acggatctcgatgctgaccgcggggaagttgcccggcaagaagctgccgct
ggaggtgctcaaagagatggaagcaatgcccggaaagctggctgcacca
ggggctgtctgatctgcctgtcccacatcaagtgcacgcccaagatgaag
aagttcatcccaggacgctgccacacctacgaaggcgacaaagagtccgc
acagggcggcataggcgaggcgatcgtcgacattcctgagattcctgggt
tcaaggacttggagcccatggagcagttcatcgcacaggtcgatctgtgt
gtggactgcacaactggctgcctcaaagggcttgccaacgtgcagtgttc
tgacctgctcaagaagtggctgccgcaacgctgtgcgacctttgccagca
agatccagggccaggtggacaagatcaaggggggcggtggtgaccgcagc
gccgaggacccaccggagcgcgacccactgaacgtgctcaagccgcggcc
ccgcgccacgcctgtgcctgtatcctgctctcgcgagctgccgagcgcag
aggaaggtgcccgcagccagcgatcctctggggggtgctgcgcagaggc
cgtggagatgctcgcggggcgcggaggcgcggataggtgtcgcccctt
tcccaggttcgtctag Human (nucleic acid sequence):
(SEQ ID NO: 206)
Atgttggggggccgcctcaggctctgggtctgtgccttgtgcagcgtctg
cagcatgagcgtcctcagagcctatcccaatgcctcccactgctcggct
ccagctggggtggcctgatccacctgtacacagccacagccaggaacagc
taccacctgcagatccacaagaatggccatgtggatggcgcacccccatca
gaccatctacagtgccctgatgatcagatcagaggatgctggctttgtgg tgattacaggtgtgatgagcagaagatacctctgcatggatttcagaggc
aacattttggatcacactatttcgacccggagaactgcaggttccaaca
ccagacgctggaaaacgggtacgacgtctaccactctcctcagtatcact
tcctggtcagtctgggccgggcgaagagagccttcctgccaggcatgaac
ccaccccgtactcccagttcctgtcccggaggaacgagatcccccctaat
tcacttcaacaccccccataccacggcggcacacccggagcaagcccaccg
agaacaacgaagacttcaacatcgtggccgtggccagcaacttcgcgacc
acggatctcgatgctgaccgcggggaagttgcccggcaagaagctgccgct
ggaggtgctcaaagagatggaagcaatgcccggaaagctggctgcacca
ggggctgtctgatctgcctgtcccacatcaagtgcacgcccaagatgaag
aagttcatcccaggacgctgccacacctacgaaggcgacaaagagtccgc
acagggcggcataggcgaggcgatcgtcgacattcctgagattcctgggt
tcaaggacttggagcccatggagcagttcatcgcacaggtcgatctgtgt
gtggactgcacaactggctgcctcaaagggcttgccaacgtgcagtgttc
tgacctgctcaagaagtggctgccgcaacgctgtgcgacctttgccagca
agatccagggccaggtggacaagatcaagggggccggtggtgaccggagc
gccgaggacgactcggagcgggacccctgaacgtgctgaagcccgggc
ccggatgacccagcccccggccctccgttcacagggctcccgagccgcg
aggacaacagcccgatgccagtgacccattaggggtggtcagggggcggt
cgagtgaacacgcacgctgggggaacgggccccggaaggctgccgcccctt
cgccaagttcatctag IL1B Mouse (nucleic acid sequence):
(SEQ ID NO: 207)
Atggcaactgttcctgaactcaactgtgaaatgccaccttttgacagtga
tgagaatgacctgttctttgaagttgacggcccaaaagatgaagggct
gcttccaaaccttgacctgggctgtcctgatgagagcatccagcttcaa
atctcgcagcagcacatcaacaagagcttcaggcaggcagtatcactcat
tgtggctgtggagaagctgtggcagctacctgtgtctttcccgtggacct
tccaggatgaggacatgagccaacttctttcctttcatctttgaagaagaa
cccatcctctgtgactcatgggatgatgataacctgctggtgtgtga
cgttcccaagccaccgagaacaacgaagacttcaacatcgtggccgtgg
ccagcaacttcgcgaccacggatctcgatgctgaccgcggggaagttgccc
ggcaagaagctgccgctggaggtgctcaaagagattggaagccaatgccc
ggaaagctggctgcaccaggggctgtctgatctgcctgtcccacatcaag
tgcacgcccaagatgaagaagttcatcccaggacgctgccacacctacga
aggcgacaaagagtccgcacagggcggcataggcgaggcgatcgtcgaca
ttcctgagattcctgggttcaaggacttggagcccatggagcagttcatc
gcacaggtcgatctgtgtgtggactgcacaactggctgcctcaaagggct
tgccaacgtgcagtgttctgacctgctcaagaagtggctgccgcaacgct
gtgcgacctttgccagcaagatccagggccaggtggacaagatcaagggg
gccggtggtgacctggtgtgtgacgttcccgttcccattagacaactgca
ctacacctggacagatgaacaacaaaaagcctcgtgctgtcggaccgcat
atgagctgaaagctctccaccctcaatggacagaatatcaaccaacaagtg
atattctccatgagctttgtacaaggagaaccaagcaacgacaaatacc
tgtggccttgggcctcaaaggaaagaatctatacctgtcctgtgtaatga
aagacggcacaccccacccctgcagctgaaggaacaagttggtggatccaacatac
ccaaagaagaagatggaaaaacggtttgtcttcaacaagatagaagtcaa
gagcaaagtggagtttgagtctgcagagttccccaactggtacatcagca
cctcacaagcagagcacaagcctgtcttcctgggaaacaacagtggtcag
gacataattgacttcaccatggaatccgtgtcttcctaa IL1B Human (nucleic acid sequence):
(SEQ ID NO: 208)
Atggcagaagtacctgagctcgccagtgaaatgatggctttattacagtgg
caatgaggatgacttgttctttgaagctgatggccctaaacagatgaagt
gctccttccaggacctggacctctgccctctggatggcggcatccagcta
cgaatctccgaccaccactacagcaagggcttcaggcaggccgcgtcagt
tgttgtggccatgacaagctgaggaagatgctggttccctgcccacaga
ccttccaggagaatgacctgagcaccttctttccctttcatctttgaagaa
gaaccctatcttcttcgacacatgggataacgaggttatgtgcacgatgc
acctaagcccaccgagaacaacgaagacttcaacatcgtggccgtggcca
gcaacttcgcgaccacggatctcgatgctgaccgcggggaagttgcccggc
aagaagctgccgctggaggtgctcaaagagattggaagccaatgcccgga
aagctggctgcaccaggggctgtctgatctgcctgtcccacatcaagtgca
cgcccaagatgaagaagttcatcccaggacgctgccacacctacgaaggc
gacaaagagtccgcacagggcggcataggcgaggcgatcgtcgacattcc
tgagattcctgggttcaaggacttggagcccatggagcagttcatcgcac
aggtcgatctgtgtgtggactgcacaactggctgcctcaaagggcttgcc
aacgtgcagtgttctgacctgctcaagaagtggctgccgcaacgctgtgc
gacctttgccagcaagatccagggccaggtggacaagatcaagggggccg
gtggtgactatgtgcacgatgcacctgtacgatcactgaactgcacgctc
cgggactcacagcaaaaagcttggtgatgtctggtccatatgaactgaa
agctctccacctccagggacaggatatggagcaacaagtggtgttctcca
tgtcctttgtacaaggagaagaaagtaatgacaaaatacctgtggccttg
ggcctcaaaggaaagaatctgtacctgtcctgcgtgttgaaagatgataa
gcccactctacagctggagagtgtagatcccaaaaattacccaaaagaaga
agatggaaaagcgatttgtcttcaacaagatagaaatcaataacaagctg
gaatttgagtctgcccagttccccaactggtacatcagcacctctcaagc agaaaacatgcccgtcttcctgggagggaccaaaggcggccaggatataa
ctgacttcaccatgcaatttgtgtcttcctaa TNFA Mouse (nucleic acid sequence):
(SEQ ID NO: 209)
Atgagcacagaaagcatgatccgcgacgtggaactggcagaagaggcact
ccccaaaagatggggggcttccagaactccaggcggtgcctatgtctca
gcctcttctcattcctgcttgtggcaggggccaccacgctcttctgtcta
ctgaacttcggggtgatcggtccccaaagggatgagaagttccaaatgg
cctccctctcatcagttctatggcccagaccctcac*actcaga*aagccca
*ccgagaacaacgaagacttcaacatcgtggccgtggccagcaacttcgcg
accacggatctcgatgctgaccgcgggaagttgcccggcaagaagctgcc
gctggaggtgctcaaagagatggaagccaatgcccggaaagctggctgca
ccaggggctgtctgatctgcctgtcccacatcaagtgcacgcccaagatg
aagaagttcatcccaggacgctgccacacctacgaaggcgacaaagagtc
cgcacagggcggcataggcgaggcgatcgtcgacattcctgagattcctg
ggttcaaggacttggagcccatggagcagttcatcgcacaggtcgatctg
tgtgtggactgcacaactggctgcctcaaagggcttgccaacgtgcagtg
ttctgacctgctcaagaagtggctgccgcaacgctgtgcgacctttgcca
gcaagatccagggccaggtggacaagatcaaggggggccggtggtgac*ctc
agat*catcttctcaaaattcgagtgacaagcctgtagcccacgtcgtagc
aaaccaccaagtggaggagcagctggagtggctgagccagcgcgccaag
ccctcctggccaacgcatgatctcaaagacaaccaactagtggtgcca
gccgatgggttgtaccttgtctactcccaggtctcttcaagggacaagg
ctgccccgactacgtgctcctcacccacaccgtcagccgatttgctatct
catccaggagaaagtcaacctcctctctgccgtcaagagccccctgccc
aaggacaccccgagggggctgagctcaaaccctggtatgagccatata
cctgggaggagtcttccagctggagaaggggaccaactcagcgctgagg
tcaatctgcccaagtacttagactttgcggagtccgggcaggtctacttt
ggagtcattgctctgtga*

TNFA Human (nucleic acid sequence):
(SEQ ID NO: 210)
Atgagcactgaaagcatgatccgggacgtggaactggcagaggagcgcact
ccccaagaagcagggggccccagggctccaggcggtgcttgttcctca
gcctcttctcctcctgatcgtggcaggcgccaccacgctcttctgcctg
ctgcactttggagtgatcggccccagagggaagagttcccagggacct
ctctctaatcagccctctggccaggca*gtcaga*aagcccaccgagaaca
acgaagacttcaacatcgtggccgtggccagcaacttcgcgaccacggat
ctcgatgctgaccgcgggaagttgcccggcaagaagctgccgctggaggt
gctcaaagagatggaagccaatgcccggaaagctggctgcaccaggggct
gtctgatctgcctgtcccacatcaagtgcacgcccaagatgaagaagttc
atcccaggacgctgccacacctacgaaggcgacaaagagtccgcacaggg
cggcataggcgaggcgatcgtcgacattcctgagattcctgggttcaagg
acttggagcccatggagcagttcatcgcacaggtcgatctgtgtgtggac
tgcacaactggctgcctcaaagggcttgccaacgtgcagtgttctgacct
gctcaagaagtggctgccgcaacgctgtgcgacctttgccagcaagatcc
agggccaggtggacaagatcaaggggggccggtggtgac*gtcagat*catctt
tctcgaaccccgagtgacaagcctgtagcccatgttgtagcaaaccctca
agctgaggggcagctccagtggctgaaccgccgggccaatgcctcctgg
ccaatggcgtggagctgagagataaccagctgtggtgtgcatcagaggc
ctgtacctcatctactcccaggtcctcttcaagggcaaggtgccctc
cacccatgtgctcctcacccacaccatcagccgcatcgccgtctcctacc
agaccaaggtcaacctcctctctgccatcaagagccctgccagagggag
acccagagggctgaggccaagccctggtatgagccatctatctggg
agggtcttccagctggagaagggtgaccgactcagcgctgagtcaatc
ggcccgactatctcgacttgccgagtctgggcaggtctactttgggatc
attgccctgtga*

IFNG Mouse (nucleic acid sequence):
(SEQ ID NO: 211)
Atgaacgctacacactgcatcttggctttgcagctcttcctcatggctgt
ttctggctgttactgccacggcacagtcattgaaagcctagaaagtctga
ataactatttttaactcaagtgcatagatgtggaagaaaagagtctcttc
ttggatatctgaggaactggcaaaaggatggtgacatgaaaatcctgca
gagccagattatctctttacctcagactctttgaagtcttgaaagaca
atcaggccatcagcaacaacataagcgtcattgaatcacacctgattact
accttcttcagcaacacaaggcgaaaaaggatgcattcatgagtattgc
caagtttgaggtcaacaaccacaaggtcagcgccaagcattcaatgagc
tcatccgagtggtccaccagctgttgccggaatcagcct*caggaagaag
cccaccgagaacaacgaagacttcaacatcgtggccgtggccagcaactt
cgcgaccacggatctcgatgctgaccgcgggaagttgcccggcaagaagc
tgccgctggaggtgctcaaagagatggaagccaatgcccggaaagctggc
tgcaccaggggctgtctgatctgcctgtcccacatcaagtgcacgcccaa
gatgaagaagttcatcccaggacgctgccacacctacgaaggcgacaaag
agtccgcacagggcggcataggcgaggcgatcgtcgacattcctgagatt
cctgggttcaaggacttggagcccatggagcagttcatcgcacaggtcga
tctgtgtgtggactgcacaactggctgcctcaaagggcttgccaacgtgc
agtgttctgacctgctcaagaagtggctgccgcaacgctgtgcgaccttt*

IFNG Human (nucleic acid sequence):
(SEQ ID NO: 212)
Atgaaatatacaagttatatcttggcttttcagctctgcatcgtttttggg
ttctcttggctgttactgccaggaccccatatgtaaaagaagcagaaaacc
ttaagaaatattttaatgcaggtcattcagatgtagcggataatggaact
cttttcttaggcatttttgaagaattggaaagaggagagtgacagaaaaat
aatgcagagccaaattgtctccttttacttcaaacttttttaaaaactta
aagatgaccagagcatccaaaagagtgtggagaccatcaaggaagacatg
aatgtcaagttttttcaatagcaacaaaagaaacgagatgacttcgaaaa
gctgactaattattcggtaactgacttgaatgtccaacgcaaagcaatac
atgaactcatccaagtgatggctgaactgtcgccagcagctaaaacaggg
aagcgaaaaaggagtcagatgctgtttcgagg*tcgaagaaagcccaccga
gaacaacgaagacttcaacatcgtggccgtggccagcaacttcgcgacca
cggatctcgatgctgaccgcgggaagttgcccggcaagaagctgccgctg
gaggtgctcaaagagatggaagccaatgcccggaaagctggctgcaccag
gggctgtctgatctgcctgtcccacatcaagtgcacgcccaagatgaaga
agttcatcccaggacgctgccacacctacgaaggcgacaaagagtccgca
cagggcggcataggcgaggcgatcgtcgacattcctgagattcctgggtt
caaggacttggagcccatggagcagttcatcgcacaggtcgatctgtgtg
tggactgcacaactggctgcctcaaagggcttgccaacgtgcagtgttct
gacctgctcaagaagtggctgccgcaacgctgtgcgacctttgccagcaa
gatccagggccaggtggacaagatcaaggggggccggtggtgacggt*cgaa
gag*catcccagtaa Sortilin Mouse (nucleic acid sequence):
(SEQ ID NO: 213)
Atggagcggccccggggagctgcggacgccctttgcgctggccctcgg
cctcctcctgctccttcaactgctgcctcctgccgccgtcggccaggacc
ggctggacgcgccgccgccgcccgcgcctcctgctgcgcgtgggccggt
ccggtcggggtgagctgggggctgcgcgccgccgcgcccgggggcccgt
ccccgcctgccgttggc*cgccg*caagcccaccgagaacaacgaagact
tcaacatcgtggccgtggccagcaacttcgcgaccacggatctcgatgct
gaccgcgggaagttgcccggcaagaagctgccgctggaggtgctcaaaga
gatggaagccaatgcccggaaagctggctgcaccaggggctgtctgatct
gcctgtcccacatcaagtgcacgcccaagatgaagaagttcatcccagga
cgctgccacacctacgaaggcgacaaagagtccgcacagggcggcatagg
cgaggcgatcgtcgacattcctgagattcctgggttcaaggacttggagc
ccatggagcagttcatcgcacaggtcgatctgtgtgtggactgcacaact
ggctgcctcaaaggcttgccaacgtgcagtgttctgacctgctcaagaa
gtggctgccgcaacgctgtgcgacctttgccagcaagatccagggccagg
tggacaagatcaaggggggccggtggtgac*cgccgc*ggccgccgccgag
gaccaagactgcggccgcctcccggacttcatcgcaagtgaccaacaa
tacgcaccagcatgtctttgatgacctcagtggctcagtgtccttgtcct
gggttggagacgacactgggtttattctcgtcctgaccacttttccaaatg
cctctggtaattgtgagctttggacagtccaagttgtatcgaagtgaggaa
ttatggaaagaactttaaggatattacaaatctcatcaataacaccttca
ttcggacgaatttggcatggctattggtcctgagaactctggaaaggtg
atactaacagcgaggtgccgggaagccgaggcggaagagtgtcag
gtcatcagactttgccaagaactttgtgcaaacagatctcccctttcatc
ctctgacgcagatgatgtacagccctcagaattctgattacctgttagct
ctcagcaccgaaaatggcctgtgggtgtccaagaatttggggaaaaatg
ggaagaaatccacaaagcagtatgtttggccaaatggggaccaaacaaa
tcatcttctttaccacccatgtgaatggctcctgcaaagctgatcttggt
gccctggaattggaagaacatccgacttgggaaaaaccttcaaaaccat
tggtgtgaaaatctactcctttggtcttgggggccgtttcctttttgcct
ctgctgatgcctgataaggacacaacaagaaggatccatgtgtcaacagac
caggggacacatggagcatggcacaacttccttctgtgggacaggaaca
gttctactccatcctggcagccaatgaggacatggtcttcatgcatgtag
atgaacctggagataccgggtttggcaccatctttaccttgatgatcga
ggcattgtctactccaagtctctggacagacatctctataccaccacagg
cggggagacggacttttaccaccgtttccctccggtctatataa
caagcacgctctcagaagataactctattcagacgcatgatcacttttga
cagggaggacggtgggagcacctcgggaagccggagaacagcaagtgcga
cgctaccgcaaagaacaagaacgagtgcagccttcatatccatgcttctt
atagcatctcccagaagctaaacgttccaatggcccacttccgagccc
aatgctgtggcatgactcatcgcacggtgtggagatgccatctc
ggtgatgtcccagatgtgtacatctcagatgatggggttactcctggg
cgaagatgctagaaggaccattactataccatcctggactctggaggc
atcattgtggccattgagcacagcaaccgtcctatcaatgtgattaagtt
ctcccacagatgaaggccagtgctggcagagctatgtgttcacacaggagc
ccatctacttcactggttcctctgccgctggcaggtcgagctccatgaag
atcagcatctgggattcacagagtctcattaccccagtgggtctc
ctacacagtcgattcaaagacatccttgagcggaattgtgaagaggat
actataccacgtggctggcacactccacagaccctggagattacaaagac
ggctgcattttgggctataaagaacagttcctacggctacgaagtcatc
cgtctgtcagaatggtcgagactatgttgtggccaagcagccatccgtct -continued gtccgtgttccctggaggacttcctctctgtgactttggctacttccgtccg
gagaacgcctcagagtgcgtggagcagcctgaactgaaggggcatgagtt
agagttctgtctgtacggcaaggaggagcacctgacaacaaatgggtacc
ggaaaatcccaggagacaaatgccaaggtgggatgaatcccgccagagaa
gtaaaagacttgaaaaagaaatgccaaagcaacttcttgaaccccacaaa
gcaggactcccgcccacagggacacagcttgtcccagaatccagtcctcgc
ctcctcttggatacactgaaaacacacacttcctatctcctacccagaag
cagaattccaagtcaaattctgtccctattatcctggccatcgtgggact
gatgcttgtcacagtcgtagcaggagtcctcattgtgaagaaatatgtct
gtggcggaaggttcctggtgcaccggtactcggtgctacagcagcacgca
gaggctgacggctagaggcttggattcaacctcccacgctaaaagcgg
atatcacgacgactcagatgaggacctcctggaatag Sortilin Human (nucleic acid sequence):
(SEQ ID NO: 214)
Atggagcggccctggggagctgcggacggcctctcgcgctggccccatgg
cctcggcctcctcctcctgcagctgctgccgccgtcgaccctcagcc
aggaccggctggacgcgccgccgccgcccgctgcgccgctgccgcgctgg
tctggccccatcggggtgagctgggggctgcgggcggccgcagccgggga
cgcgttccccgcggcggccgttggcgtcgcaagcccaccgagaacaacg
aagacttcaacatcgtggccgtggccagcaacttcgcgaccacggatctc
gatgctgaccgcggaagttgcccggcaagaagctgccgctggaggtgct
caaagagatggaagccaatgccccggaaagctggctgcaccaggggctgtc
tgatctgcctgtcccacatcaagtgcacgcccaagatgaagaagttcatc
ccaggacgctgccacacctacgaaggcgacaaagagtccgcacagggcgg
catagggcgaggcgatcgtcgacattcctgagattcctgggttcaaggact
ggagcccatggagcagttcatcgcacaggtcgatctgtgtgtggactgc
acaactggctgcctcaaagggcttgccaacgtgcagtgttctgacctgct
caagaagtggctgccgcaacgctgtgcgacctttgccagcaagatccagg
gccaggtggacaagatcaaggggccggtggtgaccgtcgcagcgcgagg
gcgaggacgaggagtgcggccgggtccgggacttcgtcgcaagctggc
caacaacacgcaccagcatgtgtttgatgatctcagaggctcagtatcct
tgtcctgggttggagatagcactgggtcattctagtcttgactaccttc
catgtaccactggtaattatgacttttggacagtccaagctatatcgaag
tgaggattatgggaagaacttaaggatatacagatctccatcaataaca
cctttattcggactgaatttggcatggctattggtcctgagaactctgga
aagtggtgttaacagcagaggtgtctggaggaagtcgtggaggaagaat
cttttagatcatcagatttgcgaagaattttgtgcaaacagatctccctt
ttcatcctctcactcagatgatgtataagccctcagaattctgattatctt
ttagctctcagcactgaaaatggcctgtgggtgtccaagaattttggggg
aaaatgggaagaaatccacaaagcagtatgttggccaaatggggatcag
acaacaccatcttctttacaacctatgcaatggctcctgcaaagctgac
cttgggctctggaattatggagaacttcagacttgggaaaaagcttcaa
aactattggtgtgaaaatctactcatttggtcttggggacgtttcctttt
ttgcctctgtgatggctgataaggatacaacaagaaggatccacgtttca
acagatcaagggggacacatggacatggcccagctccccctccgtgggaca
ggaacagttctattctattctggcagcaaatgatgacatggtattcatgc
atgtagatgaacctggagacactgggtttggcacaatctttacctcagat
gatcgaggcattgtctattccaagtctttggaccgacatctctacactac
cacagccggagagacggacttttaccaacgtgacctccctccgcggcgtct
acataacaagcgtgctctccgaagtaattctatccagaccatgatcact
tttgaccaaggaggaaggtggacgcacctgaggaagcctgaaaacagtga
atgtgatgctacagcaaaaaacaagaatgagtgcagccttcatattcatg
cttcctacagcatctcccagaaactgaatgttccaatggcccactctca
gagccgaatgccgtaggcattgtcattgctcatgtagcgtggggatgac
catctcagtgatggttccagatgtgtacatctcagatgatggggggttact
cctggacaaagatgctggaaggaccccactattacaccatcctggattc
ggaggcatcattgtggccattgagcacagcagccgtcctatcaatgtgat
taagttctccacagacgaaggtcaatgctggcaaacctacacgttcacca
gggacccatctatttcactggctcagcttcagaacctggagctaggtcc
atgaatatcgacatttgggcttcacagaatctttcctgaccagccagtg
ggtctcctacaccattgatttaaagatatccttgaaaggaactgtgaag
agaaggactataccatatggctggcacactccacagaccctgaagattat
gaaggatgctgcatttttgggctacaaagaacagtttctgcggctacgcaa
gtcatccgtgtgtcagaatggtcgagactatgttgtgaccaagcagccct
ccatctgcctctgttccctggaggacttctctctgatttgattttgctactac
cgtccagaaaatgactccaagtgtggaacagccagaactgaagggcca
cgacctggagttttgtctgtacggaagagaagaacacctaacaacaaatg
ggtaccggaaaattccaggggacaaatgccaggtgtgggtaaatccagtt
cgagaagtaaaagacttgaaaaagaaatgcacaagcaacttttgagtcc
ggaaaaacaagattccaagtcaaattctgttccaattatcctggccatcg
tgggattgatgctgctcacagtcgtagcaggagtgctcattgtgaagaaa
tatgtctgtgggggaaggttcctggtgcatcgatactctgtgctgcagca
gcatgcagaggcaatggtgtggatgtggatgctttggcacagcct
ccacactaataaaaagtggttatcatgatgactcagatgaggacctcttg
gaatag Neuropeptide W Mouse (nucleic acid sequence):
(SEQ ID NO: 215)
Ctggcgtctaacagagaagtgcggggccctgggcccgggactcccaggaa
ccggccccctgctgccctgctgctgcttctgctctcttgctaccgctgccg
ccagcgcctggtataagcacgtggcgagtccccgctatcacacagtggt
cgtgcctccgggctgctcatggggctgcgccgctcgccctaccagtgg*cg*
*ccgt*aagcccaccgagaacaacgaagacttcaacatcgtggccgtggcca
gcaacttcgcgaccacggatctcgatgctgaccgcgggaagttgcccggc
aagaagctgccgctggaggtgctcaaagagatggaagccaatgcccggaa
agctggctgcaccaggggctgtctgatctgcctgtcccacatcaagtgca
cgcccaagatgaagaagttcatcccaggacgctgccacacctacgaaggc
gacaaagagtccgcacagggcggcataggcgaggcgatcgtcgacattcc
tgagattcctgggttcaaggacttggagcccatggagcagttcatcgcac
aggtcgatctgtgtgtggactgcacaactggctgcctcaaagggcttgcc
aacgtgcagtgttctgacctgctcaagaagtggctgccgcaacgctgtgc
gacctttgccagcaagatccaggggccaggtggacaagatcaaggggccg
gtggtgacc*gccgt*gccctgggcggggctgctggacccctctcccggctc
ccaggaccggtcgcccgcggcgctctcctgcttccttcctcaggggcagga
gctgtgggaggtacgaagcaggagctcacctgcagggcttcccgtccatg
cacccctggagtccgcgggacctggagggagtccgccaaccggagcagtcg
ctaagccttcactcctggatctcagaggagcccgctgctagagccttcgg
agagacgcttcgtgcccagccatggttcctgcagcaagtcatctttgccg
atcctgtcaggccaagaaccgatggcgccccatgcttga Neuropeptide W Human (nucleic acid sequence):
(SEQ ID NO: 216)
Ctggcgtggcgcccaggggagcgggggctcccgcgagccggccgcggct
ggcactgctgctgcttctgctcctgctgccgctgccctccggcgcgtggt
acaagcacgtggcgagtccccgctaccacacggtgggccgcgcgagctcc
ctgctcatggggctgcgtcgctcacccgtatctgt*ggccgccgc*aagcccac
cgagaacaacgaagacttcaacatcgtggccgtggccagcaacttcgcga
ccacggatctcgatgctgaccgcgggaagttgcccggcaagaagctgccg
ctggaggtgctcaaagagatggaagccaatgccccgaaagctggctgcac
caggggctgtctgatctgcctgtcccacatcaagtgcacgcccaagatga
agaagttcatcccaggacgctgccacacctacgaaggcgacaaagagtcc
gcacagggcggcataggcgaggcgatcgtcgacattcctgagattcctgg
gttcaaggacttggagcccatggagcagttcatcgcacaggtcgatctgt
gtgtggactgcacaactggctgcctcaaagggcttgccaacgtgcagtgt
tctgacctgctcaagaagtggctgccgcaacgctgtgcgacctttgccag
caagatccaggggccaggtggacaagatcaaggggccggtggtgacc*gcc*
*gcg*cgctgcgcgcggccgccgggcccctggccagggacaccctctccccc
gaacccgcacgcgcgaggctcctctcctgctgcctctgtggtgtca
gctgtgggagacgcgacgcaggagctcccaggcagggatcccgtccgtg
cgccccggagcccgcgcgcccagagcctgcgctggaaccggagtccctg
gacttcagcggagctggccagagacttcggagagacgtctcccgcccagc
ggtggacccccgcagcaaaccgccttggcctgccctgcctggccccggac
cgttctga CART Mouse (nucleic acid sequence):
(SEQ ID NO: 217)
Atggagagctcccgcctgcgctgctaccccctcctgggcgccgccctgct
gctactgctacctttgctgggtgcccgtgcccaggaggacgccgagctgc
agccccgagccctggacatctactctgccgtggatgatgcgtcccacgag
aaggagctcgaagcgttgcaagaagtcctgaagaagctcaagagtaa
acgcaagcccaccgagaacaacgaagacttcaacatcgtggccgtggcca
gcaacttcgcgaccacggatctcgatgctgaccgcgggaagttgcccggc
aagaagctgccgctggaggtgctcaaagagatggaagccaatgcccggaa
agctggctgcaccaggggctgtctgatctgcctgtcccacatcaagtgca
cgcccaagatgaagaagttcatcccaggacgctgccacacctacgaaggc
gacaaagagtccgcacagggcggcataggcgaggcgatcgtcgacattcc
tgagattcctgggttcaaggacttggagcccatggagcagttcatcgcac
aggtcgatctgtgtgtggactgcacaactggctgcctcaaagggcttgcc
aacgtgcagtgttctgacctgctcaagaagtggctgccgcaacgctgtgc
gacctttgccagcaagatccaggggccaggtggacaagatcaaggggccg
gtggtgac*aaacg*cattccgatctacgagaagaagtacggccaagtccc
catgtgtgacgctggagagcagtgcgcagtgaggaaaggggccaggatcgg
gaagctgtgtgactgtccccgaggaacttcctgcaattcttttcctcttga
agtgcttgtga CART Human (nucleic acid sequence):
(SEQ ID NO: 218)
Atggagagctcccgcgtgaggctgctgccccctcctgggcgccgccctgct
gctgctgctaccttctgttgggtgcccgtgcccaggaggacgccgagctgc
agccccgagccctggacatctactctgccgtggatgatgcctcccacgag
aaggagctcatcgaagcgctgcaagaagtcttgaagaagctcaagagtaa
acgta*agcccaccgagaacaacgaagacttcaacatcgtggccgtggcca
gcaacttcgcgaccacggatctcgatgctgaccgcgggaagttgcccggc
aagaagctgccgctggaggtgctcaaagagatggaagccaatgcccggaa -continued agctggctgcaccaggggctgtctgatctgcctgtcccacatcaagtgca
cgcccaagatgaagaagttcatcccaggacgctgccacacctacgaaggc
gacaaagagtccgcacagggcggcataggcgaggcgatcgtcgacattcc
tgagattcctggggttcaaggacttggagcccatggagcagttcatcgcac
aggtcgatctgtgtgtggactgcacaactggctgcctcaaaagggcttgcc
aacgtgcagtgttctgacctgctcaagaagtggctgccgcaacgctgtgc
gacctttgccagcaagatccagggccaggtggacaagatcaaggggccg
gtggtgacaaacgtgttcccatctatgagaagaagtatggccaagtcccc
atgtgtgacgccggtgagcagtgtgcagtgaggaaaggggcaaggatcgg
gaagctgtgtgactgtccccgaggaacctcctgcaattccttcctcctga
agtgcttatga TGFB1 Mouse (nucleic acid sequence):
(SEQ ID NO: 219)
Atgccgccctcggggctgcggctactgccgcttctgctcccactcccgtg
gcttctagtgctgacgcccggggaggccagccgcgggactctccacctgca
agaccatcgacatggagctggtgaaacggaagcgcatcgaagccatccgt
ggccagatcctgtccaagctgcggctcgccagtccccccaagccaggggga
ggtaccgcccggcccgctgcccgaggcggtgctcgcctttgtacaacagca
cccgcgaccgggtggcaggcgagagcgccgacccagagccggagcccgaa
gcggactactatgctaaagaggtcaccccgcgtgctaatggtggaccgcaa
caacgccatctatgagaaaaccaaagacatctcacacagtatatatatgt
tcttcaatacgtcagacattcgggaagcagtgcccgaaccccccattgctg
tcccgtgcagagctgcgcttcagagattaaaatcaagtgtggagcaaca
tgtggaactctaccagaaatatagcaacaattcctggcgttaccttggta
accggctgctgaccccactgatacgcctgagtggctgtcttttgacgtc
actggagttgtacggcagtggctgaacaaggagacggaatacagggctt
tcgattcagcgctcactgctcttgtgacagaaagataacaaactccacg
tggaaatcaacgggatcagccccaaacgtcggggcgacctgggcaccatc
catgacatgaaccggccctttcctgctcctcagtgcaccccctggaaag
ggccagcacctgcacagctcacggcaccggagaaaagcccaccgagaaca
acgaagacttcaacatcgtggccgtggccagcaacttcgcgaccacggat
ctcgatgctgaccgcgggaagttgcccggcaagaagctgccgctggaggt
gctcaaagagatggaagccaatgcccggaaagctggctgcaccaggggct
gtctgatctgcctgtcccacatcaagtgcacgcccaagatgaagaagttc
atcccaggacgctgccacacctacgaaggcgacaaagagtccgcacaggg
cggcataggcgaggcgatcgtcgacattcctgagattcctggggttcaagg
acttggagcccatggagcagttcatcgcacaggtcgatctgtgtgtggac
tgcacaactggctgcctcaaaagggcttgccaacgtgcagtgttctgacct
gctcaagaagtggctgccgcaacgctgtgcgaccttttgccagcaagatcc
agggccaggtggacaagatcaagggggccggtggtgaccggagccctg
gataccaactattgcttcagctccacagagaagaactgctgtgtgcggca
gctgtacattgacttaggaaggacctgggttggaagtggatccacgagc
ccaagggctaccatgccaacttctgtctgggacctgccctatatttgg
agcctggacacacagtacagcaaggtcctgccctctacaaccaacacaa
cccgggcgcttcggcgtcaccgtgctgcgtgccgcaggctttggagccac
tgccatcgtactacgtgggtcgcaagcccaaggtggagcagttgtcc
aacatgattgtgcgctcctgcaagtgcagctga TGFB1 Human (nucleic acid sequence):
(SEQ ID NO: 220)
Atgccgccctccgggctgcggctgctgccgctgctgctaccgctgctgtg
gctactggtgctgacgcctggccgccggccgcgggactatccacctgca
agactatcgacatggagctggtgaagcggaagcgcatcgaggccatccgc
ggccagatcctgtccaagctgcggctcgccagccccccagccgagggga
ggtgccgcccggcccgctgcccgaggcggtgctcgccctgtacaacagca
cccgcgaccgggtggccgggagtgcagaaccggagcccgagcctgag
gccgactactacgccaaggaggtcacccgcgtgctaatggtggaaaccca
caacgaaatctatgaaacaagtcaagcagagtacacacagcatatatatgt
tcttcaacacatcagagctccggaaggcagtacctgaaccgcgtgttgctc
tcccggggcagagctgcgtctgctgaggctcaagttaaaagtggagcagca
cgtggagctgtaccagaaatacagcaacaattcctggcgataccttcagca
accggctgctggcacccagcgactcgcagagtggttatcttttgatgtc
accggagttgtcggcagtggctgaacaaggagacggaaatttgagggctt
tcgccttagcgcccactgctcctgtgacagcagggataacacactgcaag
tggacatcaacgggttcactaccggccgccgaggtgacctggccaccatt
catggcatgaaccggccttttcctgcttctcatggccacccgctggagag
ggccagcatctgcagaagctccccggaccgccgaaagcccaccgagaaca
acgaagacttcaacatcgtggccgtggccagcaacttcgcgaccacggat
ctcgatgctgaccgcgggaagttgcccggcaagaagctgccgctggaggt
gctcaaagatggaagccaatgcccggaaagctggctgcaccaggggct
gtctgatctgcctgtcccacatcaagtgcacgcccaagatgaagaagttc
atcccaggacgctgccacacctacgaaggcgacaaagagtccgcacaggg
cggcataggcgaggcgatcgtcgacattcctgagattcctggggttcaagg
acttggagcccatggagcagttcatcgcacaggtcgatctgtgtgtggac
tgcacaactggctgcctcaaagggcttgccaacgtgcagtgttctgacct
gctcaagaagtggctgccgcaacgctgtgcgaccttttgccagcaagatcc
agggccaggtggacaagatcaagggggccggtggtgaccgccgagccctg
gacaccaactattgcttcagctccacggagaagaactgctgcgtgcggca gctgtacattgacttccgcaaggacctcggctggaagtggatccacgagc
ccaagggctaccatgccaacttctgtcctgggccctgccctatatttgg
agcctggacacagtacagcaaggtcctggccctgtacaaccagcataa
ccccgggcgcctcggcggcgccgtgctgcgtgccgcaggcgctggagccgc
tgccatcgtgtactacgtgggccgcaagcccaaggtggagcagctgtcc
aacatgatcgtgcgctcctgcaagtgcagctga TGFB2 Mouse (nucleic acid sequence):
(SEQ ID NO: 221)
Atgcactactgtgtgctgagcaccttttttgctcctgcatctggtcccgt
ggcgctcagtctgtctacctgcagcaccctcgacatggatcagtttatgc
gcaagaggatcgaggccatccgcgggcagatcctgagcaagctgaagctc
accagcccccggaagactatcctgagcccggatgaggtccccccggaggt
gatttccatctacaacagtaccgcaggagaaggcaagcc
ggagggcagccgcctgcgagcgcgagcggagcgacgaggagtactacgcc
aaggaggtttataaatcgacatgccgtcccacctcccctccgaaaatgc
catcccgcccactttctacagaccctacttcagaatcgtccgctttgatg
tctcaacaatggagaaaaatgcttcgaatctggtgaaggcagagttcagg
gtcttccgcttgcaaaaccccaaagccagagtggccgagcagcggattga
actgtatcagatccttaaatccaaagactaacatctccccacccagcgct
acatcgatagcaaggttgtgaaaaccagagcggaggtgaatggctctcc
ttcgacgtgacagacgctgtgaggagtggcttcaccacaaagacaggaa
cctggggttttaaaataagttttacactgcccctgctgtaccttcgtgccgt
ctaataattacatcatcccgaataaaagcgaagagctcgaggcgagattt
gcaggtattgatgcacctctacatatgccagtggtgatcagaaaactat
aaagtccactaggaaaaaacagtgggaagaccccacatctcctgctaa
tgttgttgccctcctacagactggagtcacaacaaatccagccggcggaag
cccaccgagaacaacgaagacttcaacatcgtggccgtggccagcaactt
cgcgaccacggatctcgatgctgaccgcgggaagttgcccggcaagaagc
tgccgctggaggtgctcaaagagatggaagccaatgcccggaaagctggc
tgcaccaggggctgtctgatctgcctgtcccacatcaagtgcacgcccaa
gatgaagaagttcatcccaggacgctgccacacctacgaaggcgacaaag
agtccgcacagggcggcataggcgaggcgatcgtcgacattcctgagatt
cctggggttcaaggacttggagcccatggagcagttcatcgcacaggtcg
tctgtgtgtggactgcacaactggctgcctcaaagggcttgccaacgtgc
agtgttctgacctgctcaagaagtggctgccgcaacgctgtgcgaccttt
gccagcaagatccagggccaggtggacaagatcaaggggccggtggtga
ccggcggaagaagcgcttggatgctgcctactgcttagaaatgtgc
aggataattgctgcttcgcctcttacattgattttaagagggatctt
ggatgaaattggatccatgaacccaaaggtacaatgctaacttctgtgc
tggggcatgccatatctatggagttcagacactcaacacaccaaagtcc
tcagcctgtacaacaccataaatcccgaagcttccgcttcccttgctgt
gtgtcccaggatcttggaaccactgaccattctctattacattggaaatac
gcccaagatcgaacagctttccaatatgattgtcaagtcttgtaaatgca
gctaa TGFB2 Human (nucleic acid sequence):
(SEQ ID NO: 222)
Atgcactactgtgtgctgagcgcttttctgatcctgcatctggtcacggt
cgcgctcagcctgtctacctgcagcacactcgatatggaccagttcatgc
gcaagaggatcgaggccgatccgcggggcagatcctgagcaagctgaagctc
accagtccccagaagactatcctgagcccgaggaagtccccccggaggt
gatttccatctacaacagcaccagggacttgctccaggagaaggcgagcc
ggagggcggccgcctgcgagcgcgagaggagcgacgaagagtactacgcc
aaggaggtttataaatcacatgccgtcccacctcccctccgaaaatgt
ctgcccagttgttacaacacccctctggctcagtgggcagcttgtgctcca
gacagtcccaggtgctctgtgggtacttgatgccatcccgcccactttc
tacagaccctacttcagaattgttcgatttgacgtctcagcaatggagaa
gaattgcttcaaatttggtgaaagcagagttcagatgctcttcgttgaga
acccaaaaagccagagtgcctgaacaccggattgagctatatcagattctc
aagtccaaagatttaacatctccaacccagcgctacatcgacagcaaagt
tgtgaaaacaagagcagaaggcgaatggctctccttcgatgtaactgatg
ctgttcatgaatggcttcaccataaagacaggaacctgggatttaaaata
agctcacactgtccctgctgcacttttgtaccatctaataattacatcat
cccaaataaagtgaagaacaagatttgcaggtattgatgcac
cctccacatataccagtggtgatcagaaaactataaagtccactaggaaa
aaaaacagtgggaagaccccacatctcctgctaatgttattgccctccta
cagacttgagtcacaacagacaaccggcggaagcccaccgagaacaacg
aagacttcaacatcgtggccgtggccagcaacttcgcgaccacggatctc
gatgctgaccgcgggaagttgcccggcaagaagctgccgctggaggtgct
caaagatggaagccaatgcccggaaagctggctgcaccaggggctgtc
tgatctgcctgtcccacatcaagtgcacgcccaagatgaagaagttcatc
ccaggacgctgccacacctacgaaggcgacaaagagtccgcacagggcgg
cataggcgaggcgatcgtcgacattcctgagattcctggggttcaaggac
ttggagcccatggagcagttcatcgcacaggtcgatctgtgtgtggactgc
acaactggctgcctcaaagggcttgccaacgtgcagtgttctgacctgct
caagaagtggctgccgcaacgctgtgcgaccttttgccagcaagatccagg
gccaggtggacaagatcaaggggccggtggtgaccggcggaagaagcgt
gctttggatgcggcctattgctttagaaatgtgcaggataattgctgcct acgtccactttacattgatttcaagagggatctagggtggaaatggatac
acgaacccaaagggtacaatgccaacttctgtgctggagcatgcccgtat
ttatggagttcagacactcagcacagcagggtcctgagcttatataatac
cataaatccagaagcatctgcttctccttgctgcgtgtcccaagatttag
aacctctaaccattctctactacattggcaaaacacccaagattgaacag
ctttctaatatgattgtaaagtcttgcaaatgcagctaa TGFB3 Mouse (nucleic acid sequence):
(SEQ ID NO: 223)
Atgaagatgcacttgcaaagggctctggtagtcctggccctgctgaactt
ggccacaatcagcctctctctgtccacttgcaccacgttggacttcggcc
acatcaagaagaagagggtggaagccattaggggacagatcttgagcaag
ctcaggctcaccagcccccctgagccatcggtgatgacccacgtcccta
tcaggtcctggcactttacaacagcacccgggagttgctggaagagtgc
acggggaggggaggaaggctgcactcaggagacctcggagtctgagtac
tatgccaaagagatccataaattcgacatgatccagggactggcggagca
caatgaactggccgtctgccccaaaggaattacctctaaggttttttcgtt
tcaatgtgtcctcagtggagaaaaatggaaccaatctgttccgggcagag
ttccgggtcttgcgggtgcccaaccccagctccaagcgcacagagcagag
aattgagctcttccagatacttcgaccggatgagcacatagccaagcagc
gctacataggtggcaagaatctgcccacaaggggcaccgctgaatggctg
tctttcgatgtcactgaccactgtcgcgagtggctgttgaggagagctg
caacttgggtctggaaatcagcatccactgtccatgtcacacctttcagc
ccaatggagacatactggaaaatgttcatgaggtgatggaaatcaaattc
aaaggagtggacaatgaagatgaccatggccgtgagacctggggcgtct
caagaagcaaaaggatcaccacaaccccacctgatcctcatgatgatcc
ccacaccgactggacagcccaggccagggcagtcag*aggaagaagccc*
*accgagaacaacgaagacttcaacatcgtggccgtggcagcaacttcgc*
*gaccacggatctcgatgctgaccgcgggaagttgcccggcaagaagctgc*
*cgctggaggtgctcaaagagatggaagccaatgcccggaaagctggctgc*
*accaggggctgtctgatctgcctgtcccacatcaagtgcacgcccaagat*
*gaagaagttcatcccaggacgctgccacacctacgaaggcgacaaagagt*
*ccgcacagggcggcataggcgaggcgatcgtcgacattcctgagattcct*
*gggttcaaggacttggagcccatggagcagttcatcgcacaggtcgatct*
*gtgtgtggactgcacaactggctgcctcaaagggcttgccaacgtgcagt*
*gttctgacctgctcaagaagtggctgccgcaacgctgtgcgacctttgcc*
*agcaagatccagggccaggtggacaagatcaaggggggccggtggtgaca*q
*gaagaag*agggccctggacaccaattactgcttccgcaacctggaggaga
actgctgtgtgcgccccctctacattgacttccgacaggatctgggctgg
aagtgggtccatgaacctaagggctactgccaacttctgctcaggccc
ttgcccataccccgcagcgcagacacaacccatagcacggtgcttggac
tatacaacaccctgaacccagaggcgtctgcctcgccatgctgcgtcccc
caggacctggagcccctgaccatcctgtactatgtgggcagaaccccaa
ggtggagcagctgtcctccaacatggtggtgaagtcgtgtaagtgcagctga TGFB3 Human (nucleic acid sequence):
(SEQ ID NO: 224)
Atgaagatgcacttgcaaagggctctggtggtcctggccctgctgaactt
tgccacggtcagcctctctctgtccacttgcaccaccttggacttcggcc
acatcaagaagaagagggtggaagccattaggggacagatcttgagcaag
ctcaggctcaccagcccccctgagccaacggtgatgacccacgtcccta
tcaggtcctggccctttacaacagcacccgggagctgctggaggagatgc
atggggagagggaggaaggctgcacccaggaaaacaccgagtcggaatac
tatgccaaagaaatccataaattcgacatgatccaggggctggcggagca
caacgaactggccgtctgccctaaaggaattacctccaaggtttttcgtt
tcaatgtgtcctcagtggagaaaaatagaaccaacctattccgagcagaa
ttccgggtcttgcgggtgcccaaccccagctctaagcggaatgagcagag
gatcgagctcttccagatccttcggcagatgagcacattgccaaacagc
gctatatcggtggcaagaatctgcccacacgggggcactgccgaggtgctg
tcctttgatgtcactgacactgtgcgtgagtggctgttgaagaagagtc
caacttaggtctagaaatcagcattcactgtccatgtcacacctttcagc
ccaatggagatatcctggaaaacattcacgaggtgatggaaatcaaattc
aaaggcgtggacaatgaggatgaccatggccgtgagatcctcatggcgcct
caagaagcagaaggatcaccacaaccccatctaatcctcatgatgattc
ccccaccggctcgacaaacccggggcaggggggtcag*aggaagaagccc*
*accgagaacaacgaagacttcaacatcgtggccgtggcagcaacttcgc*
*gaccacggatctcgatgctgaccgcgggaagttgcccggcaagaagctgc*
*cgctggaggtgctcaaagagatggaagccaatgcccggaaagctggctgc*
*accaggggctgtctgatctgcctgtcccacatcaagtgcacgcccaagat*
*gaagaagttcatcccaggacgctgccacacctacgaaggcgacaaagagt*
*ccgcacagggcggcataggcgaggcgatcgtcgacattcctgagattcct*
*gggttcaaggacttggagcccatggagcagttcatcgcacaggtcgatct*
*gtgtgtggactgcacaactggctgcctcaaagggcttgccaacgtgcagt*
*gttctgacctgctcaagaagtggctgccgcaacgctgtgcgacctttgcc*
*agcaagatccagggccaggtggacaagatcaaggggggccggtggtgaca*q
*gaag*aagcgggctttggacaccaattactgcttccgcaacttggaggaga
actgctgtgtgcgcccccttcgacattgacttccgacaggatctgggctgg
aagtgggtccatgaacccaagggctactgccaacttctgctcaggccc
ttgcccataccccgcagtgcagacacaacccacagcacggtgctgggac TGFB3 Human (nucleic acid sequence):
(SEQ ID NO: 224)
tgtacaacactctgaaccctgaagcatctgcctcgccttgctgcgtgccc
caggacctggagcccctgaccatcctgtactatgtgggaggaccccaa
agtggagcagctctccaacatggtggtgaagtcttgtaaatgtagctga PDGFA Mouse (nucleic acid sequence):
(SEQ ID NO: 225)
Atgaggacctgggcttgcctgctgctcctcggctgcggatacctcgccca
tgccctggccgaggaagccgagataccccgggagttgatcgagcggctgg
ctcgaagtcagatccacagcatccgggacccctccagcgactcttggagata
gactccgtaggggctgaggatgccttgggagacaagtctgagagccatgg
gtcccatgccattaaccatgtgcccgagaagcggcctgtgcccatt*cgca*
*gg*aagcccaccgagaacaacgaagacttcaacatcgtggccgtggcagc
aacttcgcgaccacggatctcgatgctgaccgcgggaagttgcccggcaa
gaagctgccgctggaggtgctcaaagagatggaagccaatgcccggaaag
ctggctgcaccaggggctgtctgatctgcctgtcccacatcaagtgcacg
cccaagatgaagaagttcatcccaggacgctgccacacctacgaaggcga
caaagagtccgcacagggcggcataggcgaggcgatcgtcgacattcctg
agattcctgggttcaaggacttggagcccatggagcagttcatcgcacag
gtcgatctgtgtgtggactgcacaactggctgcctcaaagggcttgccaa
cgtgcagtgttctgacctgctcaagaagtggctgccgcaacgctgtgcga
cctttgccagcaagatccagggccaggtggacaagatcaaggggggccggt
ggtgacc*gcagg*aagagaagcattcctgcagttgtccaa
gaccaggacggtcatttacgagatacctcggagccaggtggacccacat
ccgccaacttcctgatctggccccatgtgtggaggtgaaagcgctgcact
ggctgttgtaacaccagcagcgtcaagtgccagccttcacgggtccacca
ccgcagtgtcaaggtggccaaagtggagtatgtcaggaagaagccaaaat
tgaaagaggtccaggtgaggttagaggaacacctggagtgtgcatgtgcg
acctccaacctgaacccagaccatcggggaggaggagacagatgtgaggtg
a PDGFA Human (nucleic acid sequence):
(SEQ ID NO: 226)
Atgaggaccttggcttgcctgctgctcctcggctgcggatacctcgccca
tgtttctggccgaggaagccgataccccgcgagttgatcgagaggctgg
cccgcagtcagatccacagcatccgggaccctccagcgactcctggagata
gactccgtagggagtgaggattctttggacaccagcctgagagctcacgg
ggtccatgccactaagcatgtgcccgagaagcggccccctgcccatt*cgga*
*gg*aagcccaccgagaacaacgaagacttcaacatcgtggccgtggcagc
aacttcgcgaccacggatctcgatgctgaccgcgggaagttgcccggcaa
gaagctgccgctggaggtgctcaaagagatggaagccaatgcccggaaag
ctggctgcaccaggggctgtctgatctgcctgtcccacatcaagtgcacg
cccaagatgaagaagttcatcccaggacgctgccacacctacgaaggcga
caaagagtccgcacagggcggcataggcgaggcgatcgtcgacattcctg
agattcctgggttcaaggacttggagcccatggagcagttcatcgcacag
gtcgatctgtgtgtggactgcacaactggctgcctcaaagggcttgccaa
cgtgcagtgttctgacctgctcaagaagtggctgccgcaacgctgtgcga
cctttgccagcaagatccagggccaggtggacaagatcaaggggggccggt
ggtgacc*cgagg*aagagaagcatcgaggaagctgtcccgctgtctgcaa
gaccaggacggtcatttacgagattcctcggagtcaggtcgaccccacgt
ccgccaacttcctgatctggccccgtgcgtggaggtgaaacgctgcacc
ggctgctgcaacacgagcagtcaagtgccagccctccgcgtccacca
ccgcagcgtcaaggtggccaaggtggaatacgtcaggaagaagccaaaat
taaagaagtccaggtgaggtagaggagcatttggagtgcgcctgcgcg
accacaagctgaatccggatatcgggaagaggacacgggaaggcctag
ggagtcaggtaaaaaacgaaaagaaaaaggttaaaacccacctaa BDNF Mouse (nucleic acid sequence):
(SEQ ID NO: 227)
Atgttccaccaggtgagaagagtgatgaccatccttttccttactatggt
tatttcatacttcggttgcataaggcggcgcccatgaaagaagtaaacg
tccacggacaaggcaacttggcctacccaggtgtgcggacccatgggact
ctggagagcgtgaatgggcccagggcaggttcgagaggtctgacgacgac
atcactggctgacacttttgagcacgtcatcgaagagctgctggatgagg
accagaaggttcggcccacagagaaaaccataaggacgcggacttgtac
acttcccgggtgatgctcagcagtcaagtgccttggagcctcctctact
ctttctgctggaggaatacaaaaattacctggatgccgcaaacatgtcta
tgagggtt*cggcgc*aagcccaccgagaacaacgaagacttcaacatcgtg
gccgtggccagcaacttcgcgaccacggatctcgatgctgaccgcgggaa
gttgcccggcaagaagctgccgctggaggtgctcaaagagatggaagcca
atgcccggaaagctggctgcaccaggggctgtctgatctgcctgtcccac
atcaagtgcacgcccaagatgaagaagttcatcccaggacgctgccacac
ctacgaaggcgacaaagagtccgcacagggcggcataggcgaggcgatcg
tcgacattcctgagattcctgggttcaaggacttggagcccatggagcag
ttcatcgcacaggtcgatctgtgtgtggactgcacaactggctgcctcaa
agggcttgccaacgtgcagtgttctgacctgctcaagaagtggctgccgc
aacgctgtgcgacctttgccagcaagatccagggccaggtggacaagatc
aagggggccggtggtgac*cggcgc*cactccgaccctgcccgccgtgggga
gctgagcgtgtgtgacagtattagcgagtgggtcacagcggcagataaaa
agactgcagtggacatgtctggcgggacggtcacagtcctagagaaagtc ccggtatccaaaggccaactgaagcagtatttctacgagaccaagtgtaa
tcccatgggttacaccaaggaaggctgcaggggcatagacaaaaggcact
ggaactcgcaatgccgaactacccaatcgtatgttcgggcccttactatg
gatagcaaaaagagaattggctggcgattcataaggatagacacttcctg
tgtatgtacactgaccattaaaaggggaagatag BDNF Human (nucleic acid sequence):

(SEQ ID NO: 228)
Atgaccatccttttccttactatggttatttcatactttggttgcatgaa
ggctgccccccatgaaagaagcaaacatccgaggacaaggtggcttggcct
acccaggtgtgcgaccccatgggactctggagagcgtgaatgggcccaag
gcaggttcaagaggcttgacatcattggctgacactttcgaacacgtgat
agaagagctgttggatgaggaccagaaagttcggcccaatgaagaaaaca
ataaggacgcagacttgtacacgtccagggtgatgctcagtagtcaagtg
ccttggagcctcctcttctctttctgctggaggaatacaaaaattacct
agatgctgcaaacatgtccatgagggtccggcgccactctgaccctgccc
gccgaaagcccaccgagaacaacgaagacttcaacatcgtggccgtggcc
agcaacttcgcgaccacggatctcgatgctgaccgcgggaagttgccctg
caagaagctgccgctggaggtgctcaaagagatggaagccaatgcccgga
aagctggctgcaccaggggctgtctgatctgcctgtcccacatcaagtgc
acgcccaagatgaagaagttcatcccaggacgctgccacacctacgaagg
cgacaaagagtccgcacagggcggcataggcgaggcgatcgtcgacattc
ctgagattcctgggttcaaggacttggagcccatggaggcagtcatcgca
caggtcgatctgtgtgtggactgcacaactggctgcctcaaagggcttgc
aacgtgcagtgttctgacctgctcaagaagtggctgccgcaacgctgtg
cgaccttgccagcaagatccagggccaggtggacaagatcaagggggcc
ggtggtgaccgccgagggagctgagcgtgtgacagtattagtgagtg
ggtaacggcggcagacaaaaagactcgagtggacatgtcggcgggacgg
tcacagtccttgaaaaggtccctgtatcaaaaggccaactgaagcaatac
ttctacgagaccaagtgcaatcccatgggttacacaaaagaaggctgcag
gggcatagacaaaaggcattggaactcccagtgccgaactacccagtcgt
acgtgcgggcccttaccatggatagcaaaaagagaattggctggcgattc
ataaggatagacacttcttgtgtatgtacattgaccattaaaaggggaag
atag NGF Mouse (nucleic acid sequence):

(SEQ ID NO: 229)
Atgtccatgttgttctacactctgatcactgcgtttttgatcggcgtaca
ggcagaaccgtcacagatagcaatgtcccagaaggagactcgtgtccctg
aagcccactggactaaacttcagcattcccttgacacagccctccgcaga
gcccgcagtgcccctactgcaccaatagctgcccgagtgacagggcgcagac
ccgcaacatcactgtagaccccagactgtttaagaaacggagactccact
cacccccgtgtgctgttcagcaccagcctccaccccacctcttcagacact
ctggatctagacttccaggccatggtacaatccccttcaacaggactca
ccggagcaagcgcaagcccaccgagaacaacgaagacttcaacatcgtgg
ccgtggccagcaacttcgcgaccacggatctcgatgctgaccgcgggaag
ttgccccggcaagaagctgccgctggaggtgctcaaagagatggaagccaa
tgcccggaaagctggctgcaccaggggctgtctgatctgcctgtcccaca
tcaagtgcacgcccaagatgaagaagttcatcccaggacgctgccacacc
tacgaaggcgacaaagagtccgcacagggcggcataggcgaggcgatcgt
cgacattcctgagattcctgggttcaaggacttggagcccatggcagt
catcgcacaggtcgatctgtgtgtggactgcacaactggctgcctcaaa
gggcttgcaacgtgcagtgttctgacctgctcaagaagtggctgccgcaa
cgctgtgcgacctttgccagcaagatccagggccaggtggacaagatca
aggggcggtggtgacaagcggtcatccaccccaccagtcttccacatg
gggagttctcagtgtgtgacagtgtcagtgtgtgggttggagataagac
cacagccacagatcaagggcaaggaggtgacagtgctggccgaggtga
acattaacaacagtgtattcagacagtactttttgagaccaagtgccga
gcctccaatcctgttgagagtgggtgccggggcatgactccaaacactg
gaactcatactgccaccacgactcacacctttcgtcaaggcgttgacaacag
atgagaagcaggctgcctggaggtttcatccggatagacacagcctgtgtg
tgtgtgctcagcaggaaggctacaagaagaggctga NGF Human (nucleic acid sequence);

(SEQ ID NO: 230)
Atgtccatgttgttctacactctgatcacagcttttctgatcggcataca
ggcggaaccacactcagagagcaatgtccctgcaggacacaccatccccc
aagcccactggactaaacttcagcattcccttgacactgccctcgcaga
gcccgcagtgccccgcagcgggcagtagctgcacgcgtgcggggcagac
ccgcaacattactgtgaccccaggctgtttaaaagcggagactccgtt
cacccgtgtgctgtttagcacccagcctcccgtgaagctgcagacact
caggatctggactcgaggtcggtggtgctgccccttcaacaggactca
caggagcaagcggaagcccaccgagaacaacgaagacttcaacatcgtgg
ccgtggccagcaacttcgcgaccacggatctcgatgctgaccgcgggaag
ttgccccggcaagaagctgccgctggaggtgctcaaagagatggaagccaa
tgcccggaaagctggctgcaccaggggctgtctgatctgcctgtcccaca
tcaagtgcacgcccaagatgaagaagttcatcccaggacgctgccacacc
tacgaaggcgacaaagagtccgcacagggcggcataggcgaggcgatcgt
cgacattcctgagattcctgggttcaaggacttggagcccatggcagt tcatcgcacaggtcgatctgtgtgtggactgcacaactggctgcctcaaa
gggcttgccaacgtgcagtgttctgacctgctcaagaagtggctgccgca
acgctgtgcgacctttgccagcaagatccagggccaggtggacaagatca
agggggccggtggtgacaagcggtcatcatcccatcccatcttccacagg
ggcgaattctcggtgtgtgacagtgtcagcgtgtgggttgggataagac
cacagccacagacatcaagggcaaggaggtgatggtgttgggagaggtga
acattaacaacagtgtattcaaacagtactttttgagaccaagtgccgg
gacccaaatccccgttgacagcgggtgccggggcattgactcaaagcactg
gaactcatattgtaccacgactcacacctttgtcaaggcgctgaccatgg
atggcaagcaggctgcctggcggtttatccggatagatacgcctgtgtg
tgtgtgctcagcaggaaggctgtgagaagagcctga Albumin Mouse (nucleic acid sequence):

(SEQ ID NO: 231)
Atgaagtgggtaaccttctcctcctcctcttcgtctccggctctgcttt
ttccaggggtgtgtttcgcccgaaagcccaccgagaacaacgaagacttca
acatcgtggccgtggccagcaacttcgcgaccacggatctcgatgctgac
cgcgggaagttgccccggcaagaagctgccgctggaggtgctcaaagagat
ggaagccaatgcccggaaagctggctgcaccaggggctgtctgatctgcc
tgtcccacatcaagtgcacgcccaagatgaagaagttcatcccaggacgc
tgccacacctacgaaggcgacaaagagtccgcacagggcggcataggcga
ggcgatcgtcgacattcctgagattcctgggttcaaggacttggagccca
tggagcagttcatcgcacaggtcgatctgtgtgtggactgcacaactggc
tgcctcaaagggcttgccaacgtgcagtgttctgacctgctcaagaagtg
gctgccgcaacgctgtgcgacctttgccagcaagatccagggccaggtgg
acaagatcaaggggggcggtggtgaccgccgagaagcacacaagagtgag
atcgcccatcggtataatgatttgggagaacaacatttcaaaggcctagt
cctgattgccttttcccagtatctccagaaatgctcatacgatgagcatg
ccaaattagtgcaggaagtaacagactttgcaaagacgtgtgttgccgat
gagtctgccgccaactgtgacaaatccctttcacactctttttggagataa
gttgtgtgccattccaaacctccgtgaaaactatggtgaactggctgact
gctgtacaaaacaagagccccgaaagaaacgaatgtttcctgcaacacaaa
gatgacaacccccagcctgccaccatttgaaaggccagaggctgaggccat
gtgcacttctttaaggaaaacccaaccacctttatgggacactatttgc
atgaagttgccagaagacatccttatttctatgcccagaacttcttttac
tatgctgagcagtacaatgagattctgacccagtgttgtgcagaggctga
caaggaaagctgcctgaccccgaagcttgatggtgtgaaggagaaagcat
tggtctcatctgtccgtcagaatgaagtgctccagtatgcagaagttt
ggagagagctttttaaagcatgggcagtagctcgtctgagccagacatt
ccccaatgctgactttgcagaaaatcaccaaattgccaacagacctgacca
aagtcaacaaggagtgctgccatggtgacctgctggaatgcgcagatgac
agggcggaacttgccaagtacatgtgtgaaaaccaggcgactatctccag
caaactgcagacttgctgccgtaaaccactgttgaagaagcccactgtc
ttagtgaggtggagcatgacaccatgcctgctgatctgcctgccattgct
gctgattttgttgaggaccaggaagtgtgcaagaactatgctgaggccaa
ggatgtcttcctgggcacgttcttgtatgaatattcaagaagacaccctg
attactctgtatccctgtttgctgagacttgctaagaaatatgaagccat
ctgaaaggtatcgcgctgaagcaatcctccccgcatgctacgdcacagt
gcttgctgaatttcagcctcttgtagaagagcctaagaacttggtcaaaa
ccaactgtgatcttacgagaagcttggagaatatggattccaaaatgcc
attctagttcgctacaccccaggagcacctcaggtgtcaaccccaactct
cgtgaggctgcaagaaacctaggaagagtgggccaccaagtgttgtacac
ttcctgaagatcagagactgccttgtgtggaagactatctgtctgcaatc
ctgaaccgtgtgtgtctgctgcatgagaagacccccagtgagtgcatgt
taccaagtgctgtagtgatccctggtgaaaggcggccatgcttctctg
ctctgacagttgatgtgaaacatatgtccccaaagagttttaaagctgagcc
ttcaccttccactctgatatctgcacacttccagagaaggagaagcagat
taagaaacaaacggctcttgctgagctggtgaagcacaagcccaaggcta
cagcggagcaactgaagactgtcatggatgactttgtgcacagttcctgga
acatgttgcaaggctgctgacaaggacaagccgcttctcgactgagggtcc
aaacccttgtcactagtgcaaagacgccttagcctaa Albumin Human (nucleic acid sequence):

(SEQ ID NO: 232)
atgaagtgggtaacctttatttccctctttttctctttagctcggctta
ttccaggggtgtgtttcgtcgaaagcccaccgagaacaacgaagacttca
acatcgtggccgtggccagcaacttcgcgaccacggatctcgatgctgac
cgcgggaagttgccccggcaagaagctgccgctggaggtgctcaaagagat
ggaagccaatgcccggaaagctggctgcaccaggggctgtctgatctgcc
tgtcccacatcaagtgcacgcccaagatgaagaagttcatcccaggacgc
tgccacacctacgaaggcgacaaagagtccgcacagggcggcataggcga
ggcgatcgtcgacattcctgagattcctgggttcaaggacttggagccca
tggagcagttcatcgcacaggtcgatctgtgtgtggactgcacaactggc
tgcctcaaagggcttgccaacgtgcagtgttctgacctgctcaagaagtg
gctgccgcaacgctgtgcgacctttgccagcaagatccagggccaggtgg
acaagatcaaggggcggtggtgaccgtcgagatgcacacaagagtgag
gttgctcatcggtttaaagatttgggagaagaaaatttcaaagccttggt
gttgattgcctttgctcagtatcttcagcagtgtccatttgaagatcatg
taaaattagtgaatgaagtaactgaatttgcaaaaacatgtgttgctgat

```
gagtcagctgaaaattgtgacaaatcacttcatacccttttttggagacaa
attatgcacagttgcaactcttcgtgaaacctatggtgaaatggctgact
gctgtgcaaaacaagaacctgagagaaatgaatgcttcttgcaacacaaa
gatgacaacccaaacctcccccgattggtgagaccagaggttgatgtgat
gtgcactgcttttcatgacaatgaagagacattttttgaaaaaatacttat
atgaaattgccagaagacatccttactttatgcccccggaactccttttc
tttgctaaaaggtataaagctgcttttacagaatgttgccaagctgctga
taaagctgcctgcctgttgccaaagctcgatgaacttcgggatgaaggga
aggcttcgtctgccaaacagagactcaagtgtgccagtctccaaaaattt
ggagaaagagctttcaaagcatgggcagtagctcgcctgagccagagatt
tcccaaagctgagtttgcagaagtttccaagttagtgacagatcttacca
aagtccacacggaatgctgccatggagatctgcttgaatgtgctgatgac
agggcggaccttgccaagtatatctgtgaaaatcaagattcgatctccag
taaactgaaggaatgctgtgaaaaacctctgttggaaaaatcccactgca
ttgccgaagtggaaaatgatgagatgcctgctgacttgccttcattagct
gctgattttgttgaaagtaaggatgtttgcaaaaactatgctgaggcaaa
ggatgtcttcctgggcatgtttttgtatgaatatgcaagaaggcatcctg
attactctgtcgtgctgctgctgagacttgccaagacatatgaaaccact
ctagagaagtgctgtgccgctgcagatcctcatgaatgctatgccaaagt
gttcgatgaatttaaacctcttgtggaagagcctcagaatttaatcaaac
aaaattgtgagcttttgagcagcttggagagtacaaattccagaatgcg
ctattagttcgttacaccaagaaagtaccccaagtgtcaactccaactct
tgtagaggtctcaagaaacctaggaaaagtgggcagcaaatgttgtaaac
atcctgaagcaaaaagaatgccctgtgcagaagactatctatccgtggtc
ctgaaccagttatgtgtgttgcatgagaaaacgccagtaagtgacagagt
caccaaatgctgcacagaatccttggtgaacaggcgaccatgctttttcag
ctctggaagtcgatgaaacatacgttcccaaagagtttaatgctgaaaca
ttcaccttccatgcagatatatgcacactttctgagaaggagagacaaat
caagaaacaaactgcacttgttgagctcgtgaaacacaagcccaaggcaa
caaaagacaactgaagctgttatggatgatttcgcagcttttgtagag
aagtgctgcaaggctgacgataaggagacctgctttgccgaggagggtaa
aaaacttgttgctgcaagtcaagctgccttaggcttataa Calcitonin Mouse (nucleic acid sequence):
                                        (SEQ ID NO: 233)
Atgggcttcctgaagttctcccctttcctggttgtcagcatcttgctcct
gtaccaggcatgcagcctccaggcagtgcctttgaggtcaatcttggaaa
gcagcccaggcatggccactctcagtgaagaagaagttcgcctgctggct
gcactggtgcaggactatatgcagatgaaagccaggagctggagcagga
ggaagagcaggaggctgagggctctagcttggacagcccccagatctaagc
ggaagcccaccgagaacaacgaagacttcaacatcgtggccgtggccagc
aacttcgcgaccacggatctcgatgctgaccgcgggaagttgcccggcaa
```

```
gaagctgccgctggaggtgctcaaagagatggaagccaatgcccggaaag
ctggctgcaccaggggctgtctgatctgcctgtcccacatcaagtgcacg
cccaagatgaagaagttcatcccaggacgctgccacacctacgaaggcga
caaagagtccgcacagggcggcataggcgaggcgatcgtcgacattcctg
agattcctgggttcaaggacttggagcccatggagcagttcatcgcacag
gtcgatctgtgtgtggactgcacaactggctgcctcaaagggcttgccaa
cgtgcagtgttctgacctgctcaagaagtggctgccgcaacgctgtgcga
cctttgccagcaagatccagggcaggtggacaagatcaagggggccggt
ggtgacaagcggtgtgggaatctgagtacctgcatgctgggcacgtacac
acaagacctcaacaagtttcacaccttcccccaaacttcaattggggttg
aagcacctggcaagaaaagggatgtggccaaggacttggagacaaaccac
caatcccattttggcaactaa Calcitonin Human (nucleic acid sequence):
                                        (SEQ ID NO: 234)
Atgggcttccaaaagttctcccccttcctggctctcagcatcttggtcct
gttgcaggcaggcagcctccatgcagcaccattcaggtctgccctggaga
gcagccagcagacccggccacgtcagtgaggacgaagcgcgcctcctg
ctggctgcactggtgcaggactatgtgcagatgaaggccagtgagctgga
gcaggagcaagagagaggggctccagcctggacagccccagatctaagc
ggaagcccaccgagaacaacgaagacttcaacatcgtggccgtggccagc
aacttcgcgaccacggatctcgatgctgaccgcgggaagttgcccggcaa
gaagctgccgctggaggtgctcaaagagatggaagccaatgcccggaaag
ctggctgcaccaggggctgtctgatctgcctgtcccacatcaagtgcacg
cccaagatgaagaagttcatcccaggacgctgccacacctacgaaggcga
caaagagtccgcacagggcggcataggcgaggcgatcgtcgacattcctg
agattcctgggttcaaggacttggagcccatggagcagttcatcgcacag
gtcgatctgtgtgtggactgcacaactggctgcctcaaagggcttgccaa
cgtgcagtgttctgacctgctcaagaagtggctgccgcaacgctgtgcga
cctttgccagcaagatccagggcaggtggacaagatcaagggggccggt
ggtgacaagcggtgcggtaatctgagtacttgcatgctgggcacatacac
gcaggacttcaacaagtttcacacgttccccccaaactgcaattggggttg
gagcacctggaaagaaaagggatatgtccagcgacttggagagagaccat
cgccctcatgttagcatgcccccagaatgccaactaa
```

Further exemplary luciferase fusion proteins (their nucleic acid sequences) include, but are not limited to, the sequences below. The portions italicized correspond to inserted nucleotides encoding *Cypridina* luciferase without its signal peptide. Underline indicates the putative cleavage sites.

Proamylin-luciferase Mouse (nucleic acid sequence):
(SEQ ID NO: 235)

Atgatgtgcatctccaaactgccagctgtcctcctcatcctctctgtggcactgaaccacttgagagctacacctgtcagaagtggtagca accccctcagatggacaaacggaagtgcaacacggccacgtgtgccacacaacgcctggcaaacttttttggttcgttccagcaacaacctt ggtccagtcctcccaccaaccaacgtgggatcgaatacatatggc*aagagg*aatgcg*Tactgcgccactgttcattgccaggactgtc*

*cttacgaacctgatccaccaaacacagttccaacttcctgtgaagctaaagaaggagaatgtattgatagcagctgtggcacctgc*

*acgagagacatactatcagatggactgtgtgaaaataaaccaggaaaaacatgttgccgaatgtgtcagtatgtaattgaatgcag*

*agtagaggccgcaggatggtttagaacattctatggaaagagattccagttccaggaacctggtacatacgtgtgggtcaaggaa*

*ccaagggcggcgactggaaggtgtccatcaccctggagaacctggatggaaccaagggggctgtgctgaccaagacaagactg*

*gaagtggctggagacatcattgacatcgctcaagctactgagaatcccatcactgtaaacggtggagctgacccatcatcgccaa*

*cccgtacaccatcggcgaggtcaccatcgctgttgttgagatgccaggcttcaacatcaccgtcattgagttcttcaaactgatcgtga*

*tcgacatcctcggaggaagatctgtaagaatcgcccagacacagcaaacaaaggaatgatctctggcctctgtggagatcttaa*

*aatgatggaagatacagacttcacttcagatccagaacaactcgctattcagcctaagatcaaccaggagtttgacggttgtccact*

*ctatggaaatcctgatgacgttgcatactgcaaaggtcttctggagccgtacaaggacagctgccgcaacccatcaacttctacta*

*ctacaccatctcctgcgccttcgcccgctgtatgggtggagacgagcgagcctcacacgtgctgcttgactacagggagacgtgcg*

*ctgctcccgaaactagaggaacctgcgttttgtctggacatactttctacgatacatttgacaaagcaagataccaattccagggtcc*

*ctgcaaggagattcttatgccgccgactgtttctggaacacttgggatgtgaaggtttcacacaggaatgttgactcttacactgaa*

*gtagagaaagtacgaatcaggaaacaatcgactgtagtagaactcattgttgatggaaacagattctggttggaggagaagccg*

-continued tgtccgtcccgtacagctctcagaacacttccatctactggcaagatggtgacatactgactacagccatcctacctgaagctctggt ggtcaagttcaacttcaagcaactgctcgtcgtacatattagagatccattcgatggtaagacttgcggtatttgcggtaactacaacc aggatttcagtgatgattcttttgatgctgaaggagcctgtgatctgaccccaacccaccgggatgcaccgaagaacagaaacct gaagctgaacgactctgcaatagtctcttcgccggtcaaagtgatcttgatcagaaatgtaacgtgtgccacaagcctgaccgtgtc gaacgatgcatgtacgagtattgcctgaggggacaacagggtttctgtgaccacgcatgggagttcaagaaagaatgctacataa agcatggagacaccctagaagtaccagatgaatgcaaa<u>aagagg</u>aatgcggcaggggatccaaatagggaatccttggatttctta ctcgtttaa Proamylin-luciferase Human (nucleic acid sequence):
(SEQ ID NO: 236)

Atgggcatcctgaagctgcaagtatttctcattgtgctctctgttgcattgaaccatctgaaagctacacccattgaaagtcatcaggt ggaaaagcggaaatgcaacactgccacatgtgcaacgcagcgcctggcaaattttttagttcattccagcaacaactttggtgccat tctctcatctaccaacgtggga tccaatacatggc<u>aagagg</u>aatgca Tactgcgccactgttcattgccaggactgtccttacga acctgatccaccaaacacagttccaacttcctgtgaagctaaagaaggagaatgtattgatagcagctgtggcacctgcacgaga gacatactatcagatggactgtgtgaaaataaaccaggaaaaacatgttgccgaatgtgtcagtatgtaattgaatgcagagtaga ggccgcaggatggtttagaacattctatggaaagagattccagttccaggaacctggtacatacgtgttgggtcaaggaaccaagg gcggcgactggaaggtgtccatcaccctggagaacctggatggaaccaaggggctgtgctgaccaagacaagactggaagtg gctggagacatcattgacatcgctcaagctactgagaatcccatcactgtaaacggtggagctgaccctatcatcgccaacccgta caccatcggcgaggtcaccatcgctgttgttgagatgccaggcttcaacatcaccgtcattgagttcttcaaactgatcgtgatcgac atcctcggaggaagatctgtaagaatcgccccagacacagcaaacaaggaatgatctctggcctctgtggagatcttaaaatga tggaagatacagacttcacttcagatccagaacaactcgctattcagcctaagatcaaccaggagtttgacggttgtccactctatgg aaatcctgatgacgttgcatactgcaaaggtcttctggagccgtacaaggacagctgccgcaacccccatcaacttctactactacac catctcctgcgccttcgcccgctgtatggtggagacgagcgagcctcacacgtgctgcttgactacagggagacgtgcgctgctcc cgaaactagaggaacctgcgttttgtctggacatactttctacgatacatttgacaaagcaagataccaattccagggtccctgcaa ggagattcttatggccgccgactgtttctggaacacttgggatgtgaaggtttcacacaggaatgttgactcttacactgaagtagag aaagtacgaatcaggaaacaatcgactgtagtagaactcattgttgatggaaaacagattctggttggaggagaagccgtgtccgt cccgtacagctctcagaacacttccatctactggcaagatggtgacatactgactacagccatcctacctgaagctctggtggtcaa gttcaacttcaagcaactgctcgtcgtacatattagagatccattcgatggtaagacttgcggtatttgcggtaactacaaccaggatt tcagtgatgattcttttgatgctgaaggagcctgtgatctgaccccaacccaccgggatgcaccgaagaacagaaacctgaagct gaacgactctgcaatagtctcttcgccggtcaaagtgatcttgatcagaaatgtaacgtgtgccacaagcctgaccgtgtcgaacga tgcatgtacgagtattgcctgaggggacaacagggtttctgtgaccacgcatgggagttcaagaaagaatgctacataaagcatg gagacaccctagaagtaccagatgaatgcaaa<u>aagagg</u>aatgcggtagaggttttaaagagagagccactgaattacttgcccctttt ag Proinsulin-luciferase Mouse (nucleic acid sequence):
(SEQ ID NO: 237)
Atggccctgtggatgcgcttcctgcccctgctggccctgctcttcctctgggagtcccaccccacccaggcttttgtcaagcagcacctttt gtggttccacctggtggaggctctctacctggtgtgtggggagcgtggcttcttctacacacccatgtcccgccgtgaagtggaggac ccacaagtggcacaactggagctgggtggaggccgggagcaggtgaccttcagaccttggcactggaggtggcccagcaga<u>aaga</u>

<u>gg</u>Tactgcgccactgttcattgccaggactgtccttacgaacctgatccaccaaacacagttccaacttcctgtgaagctaaagaag gagaatgtattgatagcagctgtggcacctgcacgagagacatactatcagatggactgtgtgaaaataaaccaggaaaaacat gttgccgaatgtgtcagtatgtaattgaatgcagagtagaggccgcaggatggtttagaacattctatggaaagagattccagttcc aggaacctggtacatacgtgttgggtcaaggaaccaagggcggcgactggaaggtgtccatcaccctggagaacctggatggaa ccaaggggctgtgctgaccaagacaagactggaagtggctggagacatcattgacatcgctcaagctactgagaatcccatca ctgtaaacggtggagctgaccctatcatcgccaacccgtacaccatcggcgaggtcaccatcgctgttgttgagatgccaggcttca -continued acatcaccgtcattgagttcttcaaactgatcgtgatcgacatcctcggaggaagatctgtaagaatcgccccagacacagcaaac aaaggaatgatctctggcctctgtggagatcttaaaatgatggaagatacagacttcacttcagatccagaacaactcgctattcag cctaagatcaaccaggagtttgacggttgtccactctatggaaatcctgatgacgttgcatactgcaaaggtcttctggagccgtaca aggacagctgccgcaacccatcaacttctactactacaccatctcctgcgccttcgcccgctgtatgggtggagacgagcgagcct cacacgtgctgcttgactacagggagacgtgcgctgctcccgaaactagaggaacctgcgttttgtctggacatactttctacgatac atttgacaaagcaagataccaattccagggtcctgcaaggagattcttatggccgccgactgtttctggaacacttgggatgtgaa ggtttcacacaggaatgttgactcttacactgaagtagagaaagtacgaatcaggaaacaatcgactgtagtagaactcattgttga tggaaaacagattctggttggaggagaagccgtgtccgtcccgtacagctctcagaacacttccatctactggcaagatggtgacat actgactacagccatcctacctgaagctctggtggtcaagttcaacttcaagcaactgctcgtcgtacatattagagatccattcgatg gtaagacttgcggtatttgcggtaactacaaccaggatttcagtgatgattcttttgatgctgaaggagcctgtgatctgaccccaac ccaccgggatgcaccgaagaacagaaacctgaagctgaacgactctgcaatagtctcttcgccggtcaaagtgatcttgatcaga aatgtaacgtgtgccacaagcctgaccgtgtcgaacgatgcatgtacgagtattgcctgaggggacaacagggtttctgtgaccac gcatgggagttcaagaaagaatgctacataaagcatggagacaccctagaagtaccagatgaatgcaaa<u>aagcgt</u>ggcattgta gatcagtgctgcaccagcatctgctccctctaccagctggagaactactgcaactag Proinsulin-luciferase Human (nucleic acid sequence) (nucleic acid sequence):

(SEQ ID NO: 238)

Atggccctgtggatgcgcctcctgcccctgctggcgctgctggccctctggggacctgacccagccgcagcctttgtgaaccaacacc tgtgcggctcacacctggtggaagctctctacctagtgtgcggggaacgaggcttcttctacacacccaagacccgccgggaggcaga ggacctgcaggtggggcaggtggagctgggcgggggccctggtgcaggcagcctgcagcccttggccctggaggggtccctgca <u>gaagaggT</u>actgcgccactgttcattgccaggactgtccttacgaacctgatccaccaaacacagttccaacttcctgtgaagctaa agaaggagaatgtattgatagcagctgtggcacctgcacgagagacatactatcagatggactgtgtgaaaataaaccaggaaa acatgttgccaatgtgtcagtatgtaattgaatgcagagtagaggccgcaggatggttagaacattctatggaaagagattcca gttccaggaacctggtacatacgtgttgggtcaaggaaccaagggcggcgactggaaggtgtccatcaccctggagaacctggat ggaaccaagggggctgtgctgaccaagacaagactggaagtggctggagacatcattgacatcgctcaagctactgagaatccc atcactgtaaacggtggagctgaccctatcatcgccaacccgtacaccatcggcgaggtcaccatcgctgttgttgagatgccagg cttcaacatcaccgtcattgagttcttcaaactgatcgtgatcgacatcctcggaggaagatctgtaagaatcgccccagacacagc aaacaaaggaatgatctctggcctctgtggagatcttaaaatgatggaagatacagacttcacttcagatccagaacaactcgctat tcagcctaagatcaaccaggagtttgacggttgtccactctatggaaatcctgatgacgttgcatactgcaaaggtcttctggagccg tacaaggacagctgccgcaacccatcaacttctactactacaccatctcctgcgccttcgcccgctgtatgggtggagacgagcg agcctcacacgtgctgcttgactacagggagacgtgcgctgctcccgaaactagaggaacctgcgttttgtctggacatactttctac gatacatttgacaaagcaagataccaattccagggtcctgcaaggagattcttatggccgccgactgtttctggaacacttgggat gtgaaggtttcacacaggaatgttgactcttacactgaagtagagaaagtacgaatcaggaaacaatcgactgtagtagaactcat tgttgatggaaaacagattctggttggaggagaagccgtgtccgtcccgtacagctctcagaacacttccatctactggcaagatgg tgacatactgactacagccatcctacctgaagctctggtggtcaagttcaacttcaagcaactgctcgtcgtacatattagagatccat tcgatggtaagacttgcggtatttgcggtaactacaaccaggatttcagtgatgattcttttgatgctgaaggagcctgtgatctgaccc ccaacccaccgggatgcaccgaagaacagaaacctgaagctgaacgactctgcaatagtctcttcgccggtcaaagtgatcttga tcagaaatgtaacgtgtgccacaagcctgaccgtgtcgaacgatgcatgtacgagtattgcctgaggggacaacagggtttctgtg accacgcatgggagttcaagaaagaatgctacataaagcatggagacaccctagaagtaccagatgaatgcaaa<u>aagcgt</u>ggc attgtggaacaatgctgtaccagcatctgctccctctaccagctggagaactactgcaactag Proglucagon (includes GRPP, glucagon, GLP-1, GLP-2) Mouse (nucleic acid sequence):

(SEQ ID NO: 239)

Atgaagaccatttactttgtggctggattgcttataatgctggtgcaaggcagctggcagcacgcccttcaagcacagaggagaaccc -continued cagatcattcccagcttcccagacagaagcgcatgaggaccctgatgagatgaatgaagacaaacgccactcacagggcacattcac
cagcgactacagcaaatacctggactcccgccgtgcccaagattttgtgcagtggttgatgaacaccaagaggaaccggaacaacatt
gccaaacgtcatgatgaatttgagaggcatgctgaagggaccctttaccagtgatgtgagttcttacttggagggccaggcagcaaagga
attcattgcttggctggtgaaaggccgaggaaggcgagacttcccagaagaagtcgccattgccgaggaactcggccga<u>aagagaag</u>
<u>a</u>*Tactgcgccactgttcattgccaggactgtccttacgaacctgatccaccaaacacagttccaacttcctgtgaagctaaagaagg*
*agaatgtattgatagcagctgtggcacctgcacgagagacatactatcagatggactgtgtgaaaataaaccaggaaaaacatgt*
*tgccgaatgtgtcagtatgtaattgaatgcagagtagaggccgcaggatggtttagaacattctatggaaagagattccagttccag*
*gaacctggtacatacgtgttgggtcaaggaaccaagggcggcgactggaaggtgtccatcaccctggagaacctggatggaacc*
*aaggggctgtgctgaccaagacaagactggaagtggctggagacatcattgacatcgctcaagctactgagaatcccatcactg*
*taaacggtggagctgaccctatcatcgccaacccgtacaccatcggcgaggtcaccatcgctgttgttgagatgccaggcttcaac*
*atcaccgtcattgagttcttcaaactgatcgtgatcgacatcctcggaggaagatctgtaagaatcgccccagacacagcaaacaa*
*aggaatgatctctggcctctgtggagatcttaaaatgatggaagatacagacttcacttcagatccagaacaactcgctattcagcct*
*aagatcaaccaggagtttgacggttgtccactctatggaaatcctgatgacgttgcatactgcaaaggtcttctggagccgtacaag*
*gacagctgccgcaacccatcaacttctactactacaccatctcctgcgccttcgcccgctgtatgggtggagacgagcgagcctca*
*cacgtgctgcttgactacagggagacgtgcgctgctcccgaaactagaggaacctgcgttttgtctggacatactttctacgatacatt*
*tgacaaagcaagataccaattccagggtccctgcaaggagattcttatggccgccgactgtttctggaacacttgggatgtgaaggt*
*ttcacacaggaatgttgactcttacactgaagtagagaaagtacgaatcaggaaacaatcgactgtagtagaactcattgttgatgg*
*aaaacagattctggttggaggagaagccgtgtccgtcccgtacagctctcagaacacttccatctactggcaagatggtgacatact*
*gactacagccatcctacctgaagctctggtggtcaagttcaacttcaagcaactgctcgtcgtacatattagagatccattcgatggta*
*agacttgcggtatttgcggtaactacaaccaggatttcagtgatgattcttttgatgctgaaggagcctgtgatctgaccccccaaccca*
*ccgggatgcaccgaagaacagaaacctgaagctgaacgactctgcaatagtctcttcgccggtcaaagtgatcttgatcagaaat*
*gtaacgtgtgccacaagcctgaccgtgtcgaacgatgcatgtacgagtattgcctgagggacaacagggtttctgtgaccacgca*
*tgggagttcaagaaagaatgctacataaagcatggagacaccctagaagtaccagatgaatgcaaa<u>aagcgc</u>ggccgcaggca*
*cgctgatggctccttctctgacgagatgagcaccattctggataatcttgccaccagggacttcatcaactggctgattcaaaccaagatc*
*actgacaagaaatag*

Proglucagon (includes GRPP, glucagon, GLP-1, GLP-2) Human (nucleic acid sequence)
(nucleic acid sequence):

(SEQ ID NO: 240)

atgaaaagcatttactttgtggctggattattttgtaatgctggtacaaggcagctggcaacgttcccttcaagacacagaggagaaatcca
gatcattctcagcttcccaggcagacccactcagtgatcctgatcagatgaacgaggacaagcgccattcacagggcacattcaccagt
gactacagcaagtatctggactccaggcgtgcccaagattttgtgcagtggttgatgaataccaagaggaacaggaataacattgccaa
acgtcacgatgaatttgagagacatgctgaagggaccctttaccagtgatgtaagttcttatttggaaggccaagctgccaaggaattcatt
gcttggctggtgaaaggccgaggaaggcgagatttcccagaagaggtcgccattgttgaagaacttggccga<u>aagagaaga</u>*Tactg*
*cgccactgttcattgccaggactgtccttacgaacctgatccaccaaacacagttccaacttcctgtgaagctaaagaaggagaatg*
*tattgatagcagctgtggcacctgcacgagagacatactatcagatggactgtgtgaaaataaaccaggaaaaacatgttgccga*
*atgtgtcagtatgtaattgaatgcagagtagaggccgcaggatggtttagaacattctatggaaagagattccagttccaggaacct*
*ggtacatacgtgttgggtcaaggaaccaagggcggcgactggaaggtgtccatcaccctggagaacctggatggaaccaaggg*
*ggctgtgctgaccaagacaagactggaagtggctggagacatcattgacatcgctcaagctactgagaatcccatcactgtaaac*
*ggtggagctgaccctatcatcgccaacccgtacaccatcggcgaggtcaccatcgctgttgttgagatgccaggcttcaacatcacc*
*gtcattgagttcttcaaactgatcgtgatcgacatcctcggaggaagatctgtaagaatcgccccagacacagcaaacaaaggaat*
*gatctctggcctctgtggagatcttaaaatgatggaagatacagacttcacttcagatccagaacaactcgctattcagcctaagatc*
*aaccaggagtttgacggttgtccactctatggaaatcctgatgacgttgcatactgcaaaggtcttctggagccgtacaaggacagc*

-continued tgccgcaacccatcaacttctactactacaccatctcctgcgccttcgcccgctgtatgggtggagacgagcgagcctcacacgtg ctgcttgactacagggagacgtgcgctgctcccgaaactagaggaacctgcgttttgtctggacatactttctacgatacatttgaca aagcaagataccaattccagggtccctgcaaggagattcttatggccgccgactgtttctggaacacttgggatgtgaaggtttcac acaggaatgttgactcttacactgaagtagagaaagtacgaatcaggaaacaatcgactgtagtagaactcattgttgatgaaaa cagattctggttggaggagaagccgtgtccgtcccgtacagctctcagaacacttccatctactggcaagatggtgacatactgact acagccatcctacctgaagctctggtggtcaagttcaacttcaagcaactgctcgtcgtacatattagagatccattcgatggtaaga cttgcggtatttgcggtaactacaaccaggatttcagtgatgattcttttgatgctgaaggagcctgtgatctgaccccaacccaccg ggatgcaccgaagaacagaaacctgaagctgaacgactctgcaatagtctcttcgccggtcaaagtgatcttgatcagaaatgta acgtgtgccacaagcctgaccgtgtcgaacgatgcatgtacgagtattgcctgaggggacaacagggtttctgtgaccacgcatgg gagttcaagaaagaatgctacataaagcatggagacaccctagaagtaccagatgaatgcaaa<u>aagcgc</u>ggccgcagacatgc tgatggttctttctctgatgagatgaacaccattcttgataatcttgccgccagggactttataaactggttgattcagaccaaaatcactgac aggaaataa Peptide YY Mouse (nucleic acid sequence):

(SEQ ID NO: 241)

atggtggcggtgcgcaggccttggcccgtcacggtcgcaatgctgctaatcctgctcgcctgtctgggagccctggtggacgcctac cctgccaaaccagaggctcccggcgaagacgcctccccgaggagctgagccgctactacgcctccctgcgccactacctcaac ctggtcacccggcagcggtatgga<u>aaaaga</u>Tactgcgccactgttcattgccaggactgtccttacgaacctgatccaccaaaca cagttccaacttcctgtgaagctaaagaaggagaatgtattgatagcagctgtggcacctgcacgagagacatactatcagatgga ctgtgtgaaaataaaccaggaaaaacatgttgccgaatgtgtcagtatgtaattgaatgcagagtagaggccgcaggatggtttag aacattctatggaaagagattccagttccaggaacctggtacatacgtgttgggtcaaggaaccaagggcggcgactggaaggtg tccatcaccctggagaacctggatggaaccaaggggctgtgctgaccaagacaagactggaagtggctggagacatcattgac atcgctcaagctactgagaatccatcactgtaaacggtggagctgaccctatcatcgccaacccgtacaccatcggcgaggtcac catcgctgttgttgagatgccaggcttcaacatcaccgtcattgagttcttcaaactgatcgtgatcgacatcctcggaggaagatctg taagaatcgccccagacacagcaaacaaggaatgatctctggcctctgtggagatcttaaaatgatggaagatacagacttcac ttcagatccagaacaactcgctattcagcctaagatcaaccaggagtttgacggttgtccactctatggaaatcctgatgacgttgca tactgcaaaggtcttctggagccgtacaaggacagctgccgcaaccccatcaacttctactactacaccatctcctgcgccttcgccc gctgtatgggtggagacgagcgagcctcacacgtgctgcttgactacagggagacgtgcgctgctcccgaaactagaggaacct gcgttttgtctggacatactttctacgatacatttgacaaagcaagataccaattccagggtccctgcaaggagattcttatggccgcc gactgtttctggaacacttgggatgtgaaggtttcacacaggaatgttgactcttacactgaagtagagaaagtacgaatcaggaaa caatcgactgtagtagaactcattgttgatgaaaacagattctggttggaggagaagccgtgtccgtcccgtacagctctcagaac acttccatctactggcaagatggtgacatactgactacagccatcctacctgaagctctggtggtcaagttcaacttcaagcaactgc tcgtcgtacatattagagatccattcgatggtaagacttgcggtatttgcggtaactacaaccaggatttcagtgatgattcttttgatgc tgaaggagcctgtgatctgaccccaacccaccgggatgcaccgaagaacagaaacctgaagctgaacgactctgcaatagtct cttcgccggtcaaagtgatcttgatcagaaatgtaacgtgtgccacaagcctgaccgtgtcgaacgatgcatgtacgagtattgcct gagggacaacagggtttctgtgaccacgcatgggagttcaagaaagaatgctacataaagcatggagacaccctagaagtac cagatgaatgcaaa<u>aagaggagg</u>gatgtccccgcagctctgttctccaaactgctcttcacagacgacagcgacagcgagaacctcc ccttcaggccagaaggtttggaccagtggtga Peptide YY Human (nucleic acid sequence):

(SEQ ID NO: 242)

Atggtgttcgtgcgcaggccgtggcccgccttgaccacagtgcttctggccctgctcgtctgcctaggggcgctggtcgacgcctacc ccatcaaacccgaggctcccggcgaagacgcctcgccggaggagctgaaccgctactacgcctccctgcgccactacctcaacctg gtcacccggcagcggtatggg<u>aaaaga</u>Tactgcgccactgttcattgccaggactgtccttacgaacctgatccaccaaacacagtt ccaacttcctgtgaagctaaagaaggagaatgtattgatagcagctgtggcacctgcacgagagacatactatcagatggactgtg -continued

```
tgaaaataaaccaggaaaaacatgttgccgaatgtgtcagtatgtaattgaatgcagagtagaggccgcaggatggtttagaaca ttctatggaaagagattccagttccaggaacctggtacatacgtgtttgggtcaaggaaccaagggcggcgactggaaggtgtccat caccctggagaacctggatggaaccaaggggggctgtgctgaccaagacaagactggaagtggctggagacatcattgacatcg ctcaagctactgagaatcccatcactgtaaacggtggagctgacccctatcatcgccaacccgtacaccatcggcgaggtcaccatc gctgttgttgagatgccaggcttcaacatcaccgtcattgagttcttcaaactgatcgtgatcgacatcctcggaggaagatctgtaag aatcgcccagacacagcaaacaaaggaatgatctctggcctctgtggagatcttaaaatgatggaagatacagacttcacttcag atccagaacaactcgctattcagcctaagatcaaccaggagtttgacggttgtccactctatggaaatcctgatgacgttgcatactg caaaggtcttctggagccgtacaaggacagctgccgcaacccatcaacttctactactacaccatctcctgcgccttcgcccgctgt atgggtggagacgagcgagcctcacacgtgctgcttgactacagggagacgtgcgctgctcccgaaactagaggaacctgcgttt tgtctggacatactttctacgatacatttgacaaagcaagataccaattccaggtccctgcaaggagattcttatggccgccgactg tttctggaacacttgggatgtgaaggtttcacacaggaatgttgactcttacactgaagtagagaaagtacgaatcaggaaacaatc gactgtagtagaactcattgttgatggaaaacagattctggttggaggagaagccgtgtccgtcccgtacagctctcagaacacttc catctactggcaagatggtgacatactgactacagccatcctacctgaagctctggtggtcaagttcaacttcaagcaactgctcgtc gtacatattagagatccattcgatggtaagacttgcggtatttgcggtaactacaaccaggatttcagtgatgattcttttgatgctgaa ggagcctgtgatctgacccccaacccaccgggatgcaccgaagaacagaaacctgaagctgaacgactctgcaatagtctcttcg ccggtcaaagtgatcttgatcagaaatgtaacgtgtgccacaagcctgaccgtgtcgaacgatgcatgtacgagtattgcctgagg ggacaacagggttctctgtgaccacgcatgggagttcaagaaagaatgctacataaagcatggagacaccctagaagtaccagat gaatgcaaaaagaggagggacggcccggacacgcttctttccaaaacgttcttccccgacggcgaggaccgcccgtcaggtcgcg gtcggagggcccagacctgtggtga
```

Neuropeptide Y Mouse (nucleic acid sequence):

(SEQ ID NO: 243)
```
Atgctaggtaacaagcgaatggggctgtgtggactgaccctcgctctatctctgctcgtgtgtttgggcattctggctgaggggtaccc ctccaagccggacaatccgggcgaggacgcgccagcagaggacatggccagatactactccgctctgcgacactacatcaatct catcaccagacagagatatggcaagagaTactgcgccactgttcattgccaggactgtccttacgaacctgatccaccaaacaca gttccaacttcctgtgaagctaaagaaggagaatgtattgatagcagctgtggcacctgcacgagagacatactatcagatggact gtgtgaaaataaaccaggaaaaacatgttgccgaatgtgtcagtatgtaattgaatgcagagtagaggccgcaggatggtttaga acattctatggaaagagattccagttccaggaacctggtacatacgtgtttgggtcaaggaaccaagggcggcgactggaaggtgt ccatcaccctggagaacctggatggaaccaaggggggctgtgctgaccaagacaagactggaagtggctggagacatcattgac atcgctcaagctactgagaatcccatcactgtaaacggtggagctgacccctatcatcgccaacccgtacaccatcggcgaggtcac catcgctgttgttgagatgccaggcttcaacatcaccgtcattgagttcttcaaactgatcgtgatcgacatcctcggaggaagatctg taagaatcgcccagacacagcaaacaaaggaatgatctctggcctctgtggagatcttaaaatgatggaagatacagacttcac ttcagatccagaacaactcgctattcagcctaagatcaaccaggagtttgacggttgtccactctatggaaatcctgatgacgttgca tactgcaaaggtcttctggagccgtacaaggacagctgccgcaacccatcaacttctactactacaccatctcctgcgccttcgccc gctgtatgggtggagacgagcgagcctcacacgtgctgcttgactacagggagacgtgcgctgctcccgaaactagaggaacct gcgttttgtctggacatactttctacgatacatttgacaaagcaagataccaattccaggtccctgcaaggagattcttatggccgcc gactgtttctggaacacttgggatgtgaaggtttcacacaggaatgttgactcttacactgaagtagagaaagtacgaatcaggaaa caatcgactgtagtagaactcattgttgatggaaaacagattctggttggaggagaagccgtgtccgtcccgtacagctctcagaac acttccatctactggcaagatggtgacatactgactacagccatcctacctgaagctctggtggtcaagttcaacttcaagcaactgc tcgtcgtacatattagagatccattcgatggtaagacttgcggtatttgcggtaactacaaccaggatttcagtgatgattcttttgatgc tgaaggagcctgtgatctgacccccaacccaccgggatgcaccgaagaacagaaacctgaagctgaacgactctgcaatagtct cttcgccggtcaaagtgatcttgatcagaaatgtaacgtgtgccacaagcctgaccgtgtcgaacgatgcatgtacgagtattgcct
``` gaggggacaacagggtttctgtgaccacgcatgggagttcaagaaagaatgctacataaagcatggagacaccctagaagtac cagatgaatgcaaa<u>aagaggaggt</u>ccagccctgagacactgatttcagacctcttaatgaaggaaagcacagaaaacgcccccaga acaaggcttgaagacccttccatgtggtga Neuropeptide Y Human (nucleic acid sequence):

(SEQ ID NO: 244)

Atgctaggtaacaagcgactggggctgtccggactgaccctcgccctgtccctgctcgtgtgcctgggtgcgctggccgaggcgtac ccctccaagccggacaacccgggcgaggacgcaccagcggaggacatggccagatactactcggcgctgcgacactacatcaacc tcatcaccaggcagagatatggaaaacga*Tactgcgccactgttcattgccaggactgtccttacgaacctgatccaccaaacacag*

*ttccaacttcctgtgaagctaaagaaggagaatgtattgatagcagctgtggcacctgcacgagagacatactatcagatggactgt*

*gtgaaaataaaccaggaaaaacatgttgccgaatgtgtcagtatgtaattgaatgcagagtagaggccgcaggatggtttagaac*

*attctatggaaagagattccagttccaggaacctggtacatacgtgtttgggtcaaggaaccaagggcggcgactggaaggtgtcc*

*atcaccctggagaacctggatggaaccaagggggctgtgctgaccaagacaagactggaagtggctggagacatcattgacatc*

*gctcaagctactgagaatcccatcactgtaaacggtggagctgaccctatcatcgccaacccgtacaccatcggcgaggtcaccat*

*cgctgttgttgagatgccaggcttcaacatcaccgtcattgagttcttcaaactgatcgtgatcgacatcctcggaggaagatctgtaa*

*gaatcgccccagacacagcaaacaaggaatgatctctggcctctgtggagatcttaaaatgatggaagatacagacttcacttca*

*gatccagaacaactcgctattcagcctaagatcaaccaggagtttgacggttgtccactctatggaaatcctgatgacgttgcatact*

*gcaaaggtcttctggagccgtacaaggacagctgccgcaacccatcaacttctactactacaccatctcctgcgccttcgcccgct*

*gtatgggtggagacgagcgagcctcacacgtgctgcttgactacagggagacgtgcgctgctcccgaaactagaggaacctgcg*

*ttttgtctggacatactttctacgatacatttgacaaagcaagataccaattccagggtccctgcaaggagattcttatggccgccgac*

*tgtttctggaacacttgggatgtgaaggtttcacacaggaatgttgactcttacactgaagtagagaaagtacgaatcaggaaacaa*

*tcgactgtagtagaactcattgttgatggaaaacagattctggttggaggagaagccgtgtccgtcccgtacagctctcagaacactt*

*ccatctactggcaagatggtgacatactgactacagccatcctacctgaagctctggtggtcaagttcaacttcaagcaactgctcgt*

*cgtacatattagagatccattcgatggtaagacttgcggtatttgcggtaactacaaccaggatttcagtgatgattcttttgatgctga*

*aggagcctgtgatctgaccccccaacccaccgggatgcaccgaagaacagaaacctgaagctgaacgactctgcaatagtctcttc*

*gccggtcaaagtgatcttgatcagaaatgtaacgtgtgccacaagcctgaccgtgtcgaacgatgcatgtacgagtattgcctgag*

*gggacaacagggtttctgtgaccacgcatgggagttcaagaaagaatgctacataaagcatggagacaccctagaagtaccag*

*atgaatgcaaa<u>aagaggaggt</u>ccagcccagagacactgatttcagacctcttgatgagagaaagcacagaaaatgttcccagaactc*

*ggcttgaagaccctgcaatgtggtga*

Pancreatic polypeptide Mouse (nucleic acid sequence):

(SEQ ID NO: 245)

Atggccgtcgcatactgctgcctctccctgtttctcgtatccacttgggtggctctgctgctgcagcccctgcaggggacctggggagcc cccctggagccaatgtaccaggcgactatgcgacacctgagcagatggcacaatatgaaactcagctccgcagatacatcaacacac tgaccaggcctaggtatgggaagagaga*Tactgcgccactgttcattgccaggactgtccttacgaacctgatccaccaaacacagttc*

*caacttcctgtgaagctaaagaaggagaatgtattgatagcagctgtggcacctgcacgagagacatactatcagatggactgtgt*

*gaaaataaaccaggaaaaacatgttgccgaatgtgtcagtatgtaattgaatgcagagtagaggccgcaggatggtttagaacat*

*tctatggaaagagattccagttccaggaacctggtacatacgtgtttgggtcaaggaaccaagggcggcgactggaaggtgtccat*

*caccctggagaacctggatggaaccaaggggggctgtgctgaccaagacaagactggaagtggctggagacatcattgacatcg*

*ctcaagctactgagaatcccatcactgtaaacggtggagctgaccctatcatcgccaacccgtacaccatcggcgaggtcaccatc*

*gctgttgttgagatgccaggcttcaacatcaccgtcattgagttcttcaaactgatcgtgatcgacatcctcggaggaagatctgtaag*

*aatcgccccagacacagcaaacaaggaatgatctctggcctctgtggagatcttaaaatgatggaagatacagacttcacttcag*

*atccagaacaactcgctattcagcctaagatcaaccaggagtttgacggttgtccactctatggaaatcctgatgacgttgcatactg*

*caaaggtcttctggagccgtacaaggacagctgccgcaacccatcaacttctactactacaccatctcctgcgccttcgcccgctgt*

*atgggtggagacgagcgagcctcacacgtgctgcttgactacagggagacgtgcgctgctcccgaaactagaggaacctgcgttt*

-continued tgtctggacatactttctacgatacatttgacaaagcaagataccaattccagggtccctgcaaggagattcttatggccgccgactg tttctggaacacttgggatgtgaaggtttcacacaggaatgttgactcttacactgaagtagagaaagtacgaatcaggaaacaatc gactgtagtagaactcattgttgatggaaaacagattctggttggaggagaagccgtgtccgtcccgtacagctctcagaacacttc catctactggcaagatggtgacatactgactacagccatcctacctgaagctctggtggtcaagttcaacttcaagcaactgctcgtc gtacatattagagatccattcgatggtaagacttgcggtatttgcggtaactacaaccaggatttcagtgatgattcttttgatgctgaa ggagcctgtgatctgaccccaacccaccgggatgcaccgaagaacagaaacctgaagctgaacgactctgcaatagtctcttcg ccggtcaaagtgatcttgatcagaaatgtaacgtgtgccacaagcctgaccgtgtcgaacgatgcatgtacgagtattgcctgagg ggacaacagggtttctgtgaccacgcatgggagttcaagaaagaatgctacataaagcatggagacaccctagaagtaccagat gaatgcaaa<u>aagaggagg</u>gccgaggaggagaacacaggtggacttcctggagtgcagctctcccctgcaccagcccccagttg gcttgattccctgctctgcgccctggagctga Pancreatic polypeptide Human (nucleic acid sequence):
(SEQ ID NO: 246)

Atggctgccgcacgcctctgcctctccctgctgctcctgtccacctgcgtggctctgttactacagccactgctgggtgccagggag ccccactggagccagtgtacccaggggacaatgccacaccagagcagatggcccagtatgcagctgatctccgtagatacatca acatgctgaccaggcctaggtatgggaaaagaTactgcgccactgttcattgccaggactgtccttacgaacctgatccaccaaac acagttccaacttcctgtgaagctaaagaaggagaatgtattgatagcagctgtggcacctgcacgagagacatactatcagatgg actgtgtgaaaataaaccaggaaaaacatgttgccgaatgtgtcagtatgtaattgaatgcagagtagaggccgcaggatggttta gaacattctatggaaagagattccagttccaggaacctggtacatacgtgttgggtcaaggaaccaagggcggcgactggaaggt gtccatcaccctggagaacctggatgaaccaagggggctgtgctgaccaagacaagactggaagtggctggagacatcattga catcgctcaagctactgagaatcccatcactgtaaacggtggagctgacctatcatcgccaacccgtacaccatcggcgaggtca ccatcgctgttgttgagatgccaggcttcaacatcaccgtcattgagttcttcaaactgatcgtgatcgacatcctcggaggaagatct gtaagaatcgccccagacacagcaaacaaggaatgatctctggcctctgtggagatcttaaaatgatggaagatacagacttca cttcagatccagaacaactcgctattcagcctaagatcaaccaggagtttgacggttgtccactctatggaaatcctgatgacgttgc atactgcaaaggtcttctggagccgtacaaggacagctgccgcaacccccatcaacttctactactacaccatctcctgcgccttcgcc cgctgtatgggtggagacgagcgagcctcacacgtgctgcttgactacagggagacgtgcgctgctcccgaaactagaggaacct gcgttttgtctggacatactttctacgatacatttgacaaagcaagataccaattccagggtccctgcaaggagattcttatggccgcc gactgtttctggaacactgggatgtgaaggtttcacacaggaatgttgactcttacactgaagtagagaaagtacgaatcaggaaa caatcgactgtagtagaactcattgttgatggaaaacagattctggttggaggagaagccgtgtccgtcccgtacagctctcagaac acttccatctactggcaagatggtgacatactgactacagccatcctacctgaagctctggtggtcaagttcaacttcaagcaactgc tcgtcgtacatattagagatccattcgatggtaagacttgcggtatttgcggtaactacaaccaggatttcagtgatgattcttttgatgc tgaaggagcctgtgatctgaccccaacccaccgggatgcaccgaagaacagaaacctgaagctgaacgactctgcaatagtct cttcgccggtcaaagtgatcttgatcagaaatgtaacgtgtgccacaagcctgaccgtgtcgaacgatgcatgtacgagtattgcct gaggggacaacagggtttctgtgaccacgcatgggagttcaagaaagaatgctacataaagcatggagacaccctagaagtac cagatgaatgcaaa<u>aagaggagg</u>cacaaagaggacacgctggccttctcggagtgggggtccccgcatgctgctgtcccaggga gctcagcccgctggacttataa Somatostatin Mouse (nucleic acid sequence):
(SEQ ID NO: 247)

Atgctgtcctgccgtctccagtgcgccctggctgcgctctgcatcgtcctggctttgggcggtgtcaccggcgcgccctcggacccca gactccgtcagtttctgcagaagtctctggcggctgccaccgggaaacaggaactggccaagtacttcttggcagagctg<u>cgcaaaTa</u> ctgcgccactgttcattgccaggactgtccttacgaacctgatccaccaaacacagttccaacttcctgtgaagctaaagaaggaga atgtattgatagcagctgtggcacctgcacgagagacatactatcagatggactgtgtgaaaataaaccaggaaaaacatgttgcc gaatgtgtcagtatgtaattgaatgcagagtagaggccgcaggatggtttagaacattctatggaaagagattccagttccaggaa -continued cctggtacatacgtgttgggtcaaggaaccaagggcggcgactggaaggtgtccatcaccctggagaacctggatggaaccaag ggggctgtgctgaccaagacaagactggaagtggctggagacatcattgacatcgctcaagctactgagaatcccatcactgtaa acggtggagctgaccctatcatcgccaacccgtacaccatcggcgaggtcaccatcgctgttgttgagatgccaggcttcaacatca ccgtcattgagttcttcaaactgatcgtgatcgacatcctcggaggaagatctgtaagaatcgcccagacacagcaaacaaagg aatgatctctggcctctgtggagatcttaaaatgatggaagatacagacttcacttcagatccagaacaactcgctattcagcctaag atcaaccaggagtttgacggttgtccactctatggaaatcctgatgacgttgcatactgcaaaggtcttctggagccgtacaaggac agctgccgcaacccatcaacttctactactacaccatctcctgcgccttcgcccgctgtatgggtggagacgagcgagcctcacac gtgctgcttgactacagggagacgtgcgctgctcccgaaactagaggaacctgcgttttgtctggacatactttctacgatacatttga caaagcaagataccaattccagggtccctgcaaggagattcttatggccgccgactgtttctggaacacttgggatgtgaaggtttc acacaggaatgttgactcttacactgaagtagagaaagtacgaatcaggaaacaatcgactgtagtagaactcattgttgatggaa aacagattctggttggaggagaagccgtgtccgtcccgtacagctctcagaacacttccatctactggcaagatggtgacatactga ctacagccatcctacctgaagctctggtggtcaagttcaacttcaagcaactgctcgtcgtacatattagagatccattcgatggtaag acttgcggtatttgcggtaactacaaccaggatttcagtgatgattcttttgatgctgaaggagcctgtgatctgaccccaacccacc gggatgcaccgaagaacagaaacctgaagctgaacgactctgcaatagtctcttcgccggtcaaagtgatcttgatcagaaatgt aacgtgtgccacaagcctgaccgtgtcgaacgatgcatgtacgagtattgcctgaggggacaacagggtttctgtgaccacgcatg ggagttcaagaaagaatgctacataaagcatggagacaccctagaagtaccagatgaatgcaaa<ins>cgcaaa</ins>ctgtccgagcccaa ccagacagagaatgatgccctggagcccgaggatttgccccaggcagctgagcaggacgagatgaggctggagctgcagaggtct gccaactcgaacccagcaatggcacccccgggaacgcaaagctggctgcaagaacttcttctggaagacattcacatcctgttag Somatostatin Human (nucleic acid sequence):

(SEQ ID NO: 248)

Atgctgtcctgccgcctccagtgcgcgctggctgcgctgtccatcgtcctggccctgggctgtgtcaccggcgctccctcggacccca gactccgtcagtttctgcagaagtccctggctgctgccgcggggaagcaggaactggccaagtacttcttggcagagct<ins>gcgcaaa</ins>Ta ctgcgccactgttcattgccaggactgtccttacgaacctgatccaccaaacacagttccaacttcctgtgaagctaaagaaggaga atgtattgatagcagctgtggcacctgcacgagagacatactatcagatggactgtgtgaaaataaaccaggaaaaacatgttgcc gaatgtgtcagtatgtaattgaatgcagagtagaggccgcaggatggtttagaacattctatggaaagagattccagttccaggaa cctggtacatacgtgttgggtcaaggaaccaagggcggcgactggaaggtgtccatcaccctggagaacctggatggaaccaag ggggctgtgctgaccaagacaagactggaagtggctggagacatcattgacatcgctcaagctactgagaatcccatcactgtaa acggtggagctgaccctatcatcgccaacccgtacaccatcggcgaggtcaccatcgctgttgttgagatgccaggcttcaacatca ccgtcattgagttcttcaaactgatcgtgatcgacatcctcggaggaagatctgtaagaatcgcccagacacagcaaacaaagg aatgatctctggcctctgtggagatcttaaaatgatggaagatacagacttcacttcagatccagaacaactcgctattcagcctaag atcaaccaggagtttgacggttgtccactctatggaaatcctgatgacgttgcatactgcaaaggtcttctggagccgtacaaggac agctgccgcaacccatcaacttctactactacaccatctcctgcgccttcgcccgctgtatgggtggagacgagcgagcctcacac gtgctgcttgactacagggagacgtgcgctgctcccgaaactagaggaacctgcgttttgtctggacatactttctacgatacatttga caaagcaagataccaattccagggtccctgcaaggagattcttatggccgccgactgtttctggaacacttgggatgtgaaggtttc acacaggaatgttgactcttacactgaagtagagaaagtacgaatcaggaaacaatcgactgtagtagaactcattgttgatggaa aacagattctggttggaggagaagccgtgtccgtcccgtacagctctcagaacacttccatctactggcaagatggtgacatactga ctacagccatcctacctgaagctctggtggtcaagttcaacttcaagcaactgctcgtcgtacatattagagatccattcgatggtaag acttgcggtatttgcggtaactacaaccaggatttcagtgatgattcttttgatgctgaaggagcctgtgatctgaccccaacccacc gggatgcaccgaagaacagaaacctgaagctgaacgactctgcaatagtctcttcgccggtcaaagtgatcttgatcagaaatgt aacgtgtgccacaagcctgaccgtgtcgaacgatgcatgtacgagtattgcctgaggggacaacagggtttctgtgaccacgcatg ggagttcaagaaagaatgctacataaagcatggagacaccctagaagtaccagatgaatgcaaa<ins>cgcaaa</ins>ctgtctgaacccaa -continued ccagacggagaatgatgccctggaacctgaagatctgtcccaggctgctgagcaggatgaaatgaggcttgagctgcagagatctgct aactcaaacccggctatggcaccccgagaacgcaaagctggctgcaagaatttcttctggaagactttcacatcctgttag GHRH Mouse (nucleic acid sequence):

(SEQ ID NO: 249)

Atgctgctctgggtgctctttgtgatcctcatcctcaccagtggctcccactgctcactgcccccctcacctcccttcaggatgcagcgac acgtagatgccatcttcaccaccaactacaggaaactcctgagccagctgtatgcccggaaagtgatccaggacatcatgaacaagca aggggagaggatccaggaacaaagggccaggctcagccgccaggaagacagcatgtggacagaggacaagcagatgaccctgg agagcatc*cggcgg*T*actgcgccactgttcattgccaggactgtccttacgaacctgatccaccaaacacagttccaacttcctgtg*

*aagctaaagaaggagaatgtattgatagcagctgtggcacctgcacgagagacatactatcagatggactgtgtgaaaataaac*

*caggaaaaacatgttgccgaatgtgtcagtatgtaattgaatgcagagtagaggccgcaggatggtttagaacattctatggaaag*

*agattccagttccaggaacctggtacatacgtgttgggtcaaggaaccaagggcggcgactggaaggtgtccatcaccctggaga*

*acctggatggaaccaaggggctgtgctgaccaagacaagactggaagtggctggagacatcattgacatcgctcaagctactg*

*agaatcccatcactgtaaacggtggagctgacccctatcatcgccaacccgtacaccatcggcgaggtcaccatcgctgttgttgag*

*atgccaggcttcaacatcaccgtcattgagttcttcaaactgatcgtgatcgacatcctcggaggaagatctgtaagaatcgcccca*

*gacacagcaaacaaaggaatgatctctggcctctgtggagatcttaaaatgatggaagatacagacttcacttcagatccagaac*

*aactcgctattcagcctaagatcaaccaggagtttgacggttgtccactctatggaaatcctgatgacgttgcatactgcaaaggtctt*

*ctggagccgtacaaggacagctgccgcaacccc atcaacttctactactacaccatctcctgcgccttcgcccgctgtatgggtgga*

*gacgagcgagcctcacacgtgctgcttgactacagggagacgtgcgctgctcccgaaactagaggaacctgcgttttgtctggaca*

*tactttctacgatacatttgacaaagcaagataccaattccagggtccctgcaaggagattcttatggccgccgactgtttctggaac*

*acttgggatgtgaaggtttcacacaggaatgttgactcttacactgaagtagagaaagtacgaatcaggaaacaatcgactgtagt*

*agaactcattgttgatggaaaacagattctggttggaggagaagccgtgtccgtcccgtacagctctcagaacacttccatctactg*

*gcaagatggtgacatactgactacagccatcctacctgaagctctggtggtcaagttcaacttcaagcaactgctcgtcgtacatatt*

*agagatccattcgatggtaagacttgcggtatttgcggtaactacaaccaggatttcagtgatgattcttttgatgctgaaggagcctg*

*tgatctgaccccccaacccaccgggatgcaccgaagaacagaaacctgaagctgaacgactctgcaatagtctcttcgccggtcaa*

*agtgatcttgatcagaaatgtaacgtgtgccacaagcctgaccgtgtcgaacgatgcatgtacgagtattgcctgaggggacaaca*

*gggtttctgtgaccacgcatgggagttcaagaaagaatgctataaagcatggagacaccctagaagtaccagatgaatgcaa*

*ac*cggcgg*ttgcagggattcccaaggatgaagccttcagcggacgcttga*

GHRH Human (nucleic acid sequence):

(SEQ ID NO: 250)

Atgccactctgggtgttcttctttgtgatcctcaccctcagcaacagctcccactgctcccacctcccccttgaccctcaggatgcggc ggtatgcagatgccatcttccaccaacagctaccggaaggtgctgggccagctgtccgcccgcaagctgctccaggacatcatgagca ggcagcagggagagagcaaccaagagcgaggagcaagggcacggcttggtcgtcaggtagacagcatgtgggcagaacaaaag caaatgaattggagagcatcctggtggccctgcggcgg*Tactgcgccactgttcattgccaggactgtccttacgaacctgatccac*

*caaacacagttccaacttcctgtgaagctaaagaaggagaatgtattgatagcagctgtggcacctgcacgagagacatactatc*

*agatggactgtgtgaaaataaaccaggaaaaacatgttgccgaatgtgtcagtatgtaattgaatgcagagtagaggccgcagga*

*tggtttagaacattctatggaaagagattccagttccaggaacctggtacatacgtgttgggtcaaggaaccaagggcggcgactg*

*gaaggtgtccatcaccctggagaacctggatggaaccaaggggctgtgctgaccaagacaagactggaagtggctggagaca*

*tcattgacatcgctcaagctactgagaatcccatcactgtaaacggtggagctgacccctatcatcgccaacccgtacaccatcggcg*

*aggtcaccatcgctgttgttgagatgccaggcttcaacatcaccgtcattgagttcttcaaactgatcgtgatcgacatcctcggagga*

*agatctgtaagaatcgccccagacacagcaaacaaaggaatgatctctggcctctgtggagatcttaaaatgatggaagatacag*

*acttcacttcagatccagaacaactcgctattcagcctaagatcaaccaggagtttgacggttgtccactctatggaaatcctgatga*

*cgttgcatactgcaaaggtcttctggagccgtacaaggacagctgccgcaacccc atcaacttctactactacaccatctcctgcgc*

```
cttcgcccgctgtatgggtggagacgagcgagcctcacacgtgctgcttgactacagggagacgtgcgctgctcccgaaactaga
ggaacctgcgttttgtctggacatactttctacgatacatttgacaaagcaagataccaattccagggtccctgcaaggagattcttat
ggccgccgactgtttctggaacacttgggatgtgaaggtttcacacaggaatgttgactcttacactgaagtagagaaagtacgaat
caggaaacaatcgactgtagtagaactcattgttgatggaaaacagattctggttggaggagaagccgtgtccgtcccgtacagct
ctcagaacacttccatctactggcaagatggtgacatactgactacagccatcctacctgaagctctggtggtcaagttcaacttcaa
gcaactgctcgtcgtacatattagagatccattcgatggtaagacttgcggtatttgcggtaactacaaccaggatttcagtgatgatt
cttttgatgctgaaggagcctgtgatctgaccccaacccaccgggatgcaccgaagaacagaaacctgaagctgaacgactctg
caatagtctcttcgccggtcaaagtgatcttgatcagaaatgtaacgtgtgccacaagcctgaccgtgtcgaacgatgcatgtacga
gtattgcctgaggggacaacagggtttctgtgaccacgcatgggagttcaagaaagaatgctacataaagcatggagacaccta
gaagtaccagatgaatgcaaacggcggctgcagaagcacaggaactcccagggatga
```

POMC (ACTH, MSH) Mouse (nucleic acid sequence):

(SEQ ID NO: 251)

```
Atgccgagattctgctacagtcgctcagggggccctgttgctggccctcctgcttcagacctccatagatgtgtggagctggtgcctgga
gagcagccagtgccaggacctcaccacggagagcaacctgctggcttgcatccgggcttgcaaactcgacctctcgctggagacgcc
cgtgtttcctggcaacggagatgaacagcccctgactgaaaaccccggaagtacgtcatgggtcacttccgctgggaccgcttcggc
cccaggaacagcagcagtgctggcagcgcggcgcagaggcgtgcggaggaagaggcggtgtggggagatggcagtccagagcc
gagtccacgcgagggcaagcgcTactgcgccactgttcattgccaggactgtccttacgaacctgatccaccaaacacagttccaa
cttcctgtgaagctaaagaaggagaatgtattgatagcagctgtggcacctgcacgagagacatactatcagatggactgtgtgaa
aataaaccaggaaaaacatgttgccgaatgtgtcagtatgtaattgaatgcagagtagaggccgcaggatggtttagaacattcta
tggaaagagattccagttccaggaacctggtacatacgtgttgggtcaaggaaccaagggcggcgactgaaggtgtccatcacc
ctggagaacctggatggaaccaaggggctgtgctgaccaagacaagactggaagtggctggagacatcattgacatcgctcaa
gctactgagaatcccatcactgtaaacggtggagctgacccatatcgccaacccgtacaccatcggcgaggtcaccatcgctgtt
gttgagatgccaggcttcaacatcaccgtcattgagttcttcaaactgatcgtgatcgacatcctcggaggaagatctgtaagaatcg
ccccagacacagcaaacaaaggaatgatctctggcctctgtggagatcttaaaatgatggaagatacagacttcacttcagatcca
gaacaactcgctattcagcctaagatcaaccaggagtttgacggttgtccactctatggaaatcctgatgacgttgcatactgcaaa
ggtcttctggagccgtacaaggacagctgccgcaacccatcaacttctactactacaccatctcctgcgccttcgcccgctgtatgg
gtggagacgagcgagcctcacacgtgctgcttgactacagggagacgtgcgctgctcccgaaactagaggaacctgcgttttgtct
ggacatactttctacgatacatttgacaaagcaagataccaattccagggtccctgcaaggagattcttatggccgccgactgtttct
ggaacacttgggatgtgaaggtttcacacaggaatgttgactcttacactgaagtagagaaagtacgaatcaggaaacaatcgac
tgtagtagaactcattgttgatggaaaacagattctggttggaggagaagccgtgtccgtcccgtacagctctcagaacacttccatc
tactggcaagatggtgacatactgactacagccatcctacctgaagctctggtggtcaagttcaacttcaagcaactgctcgtcgtac
atattagagatccattcgatggtaagacttgcggtatttgcggtaactacaaccaggatttcagtgatgattcttttgatgctgaaggag
cctgtgatctgaccccaacccaccgggatgcaccgaagaacagaaacctgaagctgaacgactctgcaatagtctcttcgccgg
tcaaagtgatcttgatcagaaatgtaacgtgtgccacaagcctgaccgtgtcgaacgatgcatgtacgagtattgcctgaggggac
aacagggtttctgtgaccacgcatgggagttcaagaaagaatgctacataaagcatggagacaccctagaagtaccagatgaat
gcaaaaagcgctcctactccatggagcacttccgctggggcaagccggtgggcaagaaacggcgcccggtgaaggtgtaccccaa
cgttgctgagaacgagtcggcggaggcctttcccctagagttcaagagggagctggaaggcgagcggccattaggcttggagcaggt
cctggagtccgacgcggagaaggacgacgggccctaccggtggagcacttccgctggagcaacccgcccaaggacaagcgttac
ggtggcttcatgacctccgagaagagccagacgcccctggtgacgctcttcaagaacgccatcatcaagaacgcgcacaagaaggg
ccagtga
```

POMC (ACTH, MSH) Human (nucleic acid sequence):

(SEQ ID NO: 252)

Atgccgagatcgtgctgcagccgctcgggggccctgttgctggccttgctgcttcaggcctccatggaagtgcgtggctggtgcctgg agagcagccagtgtcaggacctcaccacggaaagcaacctgctggagtgcatccgggcctgcaagcccgacctctcggccgagact cccatgttcccgggaaatggcgacgagcagcctctgaccgagaaccccggaagtacgtcatgggccacttccgctgggaccgattc ggccgccgcaacagcagcagcggcagcagcggcgcagggcagaagcgcgaggacgtctcagcgggcgaagactgcggcc cgctgcctgagggcggccccgagcccgcagcgatggtgccaagccgggcccgcgcgagggc<u>aagcgc</u>Tactgcgccactgttc attgccaggactgtccttacgaacctgatccaccaaacacagttccaacttcctgtgaagctaaagaaggagaatgtattgatagca gctgtggcacctgcacgagagacatactatcagatggactgtgtgaaaataaaccaggaaaaacatgttgccgaatgtgtcagtat gtaattgaatgcagagtagaggccgcaggatggtttagaacattctatggaaagagattccagttccaggaacctggtacatacgt gttgggtcaaggaaccaagggcggcgactggaaggtgtccatcaccctggagaacctggatggaaccaagggggctgtgctga ccaagacaagactggagtggctggagacatcattgacatcgctcaagctactgagaatcccatcactgtaaacggtggagctga ccctatcatcgccaacccgtacaccatcggcgaggtcaccatcgctgttgttgagatgccaggcttcaacatcaccgtcattgagttct tcaaactgatcgtgatcgacatcctcggaggaagatctgtaagaatcgcccagacacagcaaacaaaggaatgatctctggcct ctgtggagatcttaaaatgatggaagatacagacttcacttcagatccagaacaactcgctattcagcctaagatcaaccaggagtt tgacggttgtccactctatggaaatcctgatgacgttgcatactgcaaaggtcttctggagccgtacaaggacagctgccgcaaccc catcaacttctactactacaccatctcctgcgccttcgcccgctgtatgggtgggagacgagcgagcctcacacgtgctgcttgactac agggagacgtgcgctgctcccgaaactagaggaacctgcgttttgtctggacatactttctacgatacatttgacaaagcaagatac caattccagggtccctgcaaggagattcttatggccgccgactgtttctggaacacttgggatgtgaaggtttcacacaggaatgttg actcttacactgaagtagagaaagtacgaatcaggaaacaatcgactgtagtagaactcattgttgatggaaaacagattctggttg gaggagaagccgtgtccgtcccgtacagctctcagaacacttccatctactggcaagatggtgacatactgactacagccatccta cctgaagctctggtggtcaagttcaacttcaagcaactgctcgtcgtacatattagagatccattcgatggtaagacttgcggtatttgc ggtaactacaaccaggatttcagtgatgattctttttgatgctgaaggagcctgtgatctgacccccaacccaccgggatgcaccgaa gaacagaaacctgaagctgaacgactctgcaatagtctcttcgccggtcaaagtgatcttgatcagaaatgtaacgtgtgccacaa gcctgaccgtgtcgaacgatgcatgtacgagtattgcctgaggggacaacagggtttctgtgaccacgcatgggagttcaagaaa gaatgctacataaagcatggagacaccctagaagtaccagatgaatgcaaa<u>aagcgct</u>cctactccatggagcacttccgctggg gcaagccggtgggcaagaagcggcgcccagtgaaggtgtaccctaacggcgccgaggacgagtcggccgaggccttccccctgg agttcaagagggagctgactggccagcgactccgggagggagatggccccgacggccctgccgatgacggcgcaggggcccagg ccgacctggagcacagcctgctggtggcggccgagaagaaggacgagggcccctacaggatggagcacttccgctggggcagcc cgcccaaggacaagcgctacgcggtttcatgacctccgagaagagccagacgcccctggtgacgctgttcaaaaacgccatcatca agaacgcctacaagaagggcgagtga Oxytocin Mouse (nucleic acid sequence):

(SEQ ID NO: 253)

Atggcctgccccagtctcgcttgctgcctgcttggcttactggctctgacctcggcctgctacatccagaactgcccctgggcggc<u>aa</u>

<u>gagg</u>Tactgcgccactgttcattgccaggactgtccttacgaacctgatccaccaaacacagttccaacttcctgtgaagctaaaga aggagaatgtattgatagcagctgtggcacctgcacgagagacatactatcagatggactgtgtgaaaataaaccaggaaaaac atgttgccgaatgtgtcagtatgtaattgaatgcagagtagaggccgcaggatggtttagaacattctatggaaagagattccagttc caggaacctggtacatacgtgttgggtcaaggaaccaagggcggcgactggaaggtgtccatcaccctggagaacctggatgga accaagggggctgtgctgaccaagacaagactggagtggctggagacatcattgacatcgctcaagctactgagaatcccatc actgtaaacggtggagctgaccctatcatcgccaacccgtacaccatcggcgaggtcaccatcgctgttgttgagatgccaggcttc aacatcaccgtcattgagttcttcaaactgatcgtgatcgacatcctcggaggaagatctgtaagaatcgcccagacacagcaaa caaaggaatgatctctggcctctgtggagatcttaaaatgatggaagatacagacttcacttcagatccagaacaactcgctattca gcctaagatcaaccaggagtttgacggttgtccactctatggaaatcctgatgacgttgcatactgcaaaggtcttctggagccgtac aaggacagctgccgcaacccccatcaacttctactactacaccatctcctgcgccttcgcccgctgtatgggtgggagacgagcgagc -continued

```
ctcacacgtgctgcttgactacagggagacgtgcgctgctcccgaaactagaggaacctgcgttttgtctggacatactttctacgat
acatttgacaaagcaagataccaattccagggtccctgcaaggagattcttatggccgccgactgtttctggaacacttgggatgtg
aaggtttcacacaggaatgttgactcttacactgaagtagagaaagtacgaatcaggaaacaatcgactgtagtagaactcattgtt
gatgggaaacagattctggttggaggagaagccgtgtccgtcccgtacagctctcagaacacttccatctactggcaagatggtga
catactgactacagccatcctacctgaagctctggtggtcaagttcaacttcaagcaactgctcgtcgtacatattagagatccattcg
atggtaagacttgcggtatttgcggtaactacaaccaggatttcagtgatgattcttttgatgctgaaggagcctgtgatctgacccccc
aacccaccgggatgcaccgaagaacagaaacctgaagctgaacgactctgcaatagtctcttcgccggtcaaagtgatcttgatc
agaaatgtaacgtgtgccacaagcctgaccgtgtcgaacgatgcatgtacgagtattgcctgaggggacaacagggtttctgtgac
cacgcatgggagttcaagaaagaatgctacataaagcatggagacaccctagaagtaccagatgaatgcaaaaagcgcgctgt
gctggacctggatatgcgcaagtgtctcccctgcggcccgggcggcaaaggacgctgcttcggaccaagcatctgctgcgcggacg
agctgggctgcttcgtgggcaccgccgaggcgctgcgctgccaggaggagaactacctgccttcgccctgccagtctggccagaag
ccctgcgggagcggaggccgctgcgccgccacaggcatctgctgcagcccggatggctgccgcacagaccccgcctgcgaccctg
agtctgccttctcggagcgctga
```

Oxytocin Human (nucleic acid sequence):

(SEQ ID NO: 254)

```
Atggccggccccagcctcgcttgctgtctgctcggcctcctggcgctgacctccgcctgctacatccagaactgcccctgggaggca
agaggTactgcgccactgttcattgccaggactgtccttacgaacctgatccacaccaaacacagttccaacttcctgtgaagctaaag
aaggagaatgtattgatagcagctgtggcacctgcacgagagacatactatcagatggactgtgtgaaaataaaccaggaaaaa
catgttgccgaatgtgtcagtatgtaattgaatgcagagtagaggccgcaggatggtttagaacattctatggaaagagattccagtt
ccaggaacctggtacatacgtgtgggtcaaggaaccaagggcggcgactggaaggtgtccatcaccctggagaacctggatgg
aaccaaggggctgtgctgaccaagacaagactggaagtggctggagacatcattgacatcgctcaagctactgagaatcccat
cactgtaaacggtggagctgacctatcatcgccaacccgtacaccatcggcgaggtcaccatgctgttgttgagatgccaggctt
caacatcaccgtcattgagttcttcaaactgatcgtgatcgacatcctcggaggaagatctgtaagaatcgccccagacacagcaa
acaaaggaatgatctctggcctgtgtggagatcttaaaatgatggaagatacagacttcacttcagatccagaacaactcgctattc
agcctaagatcaaccaggagtttgacggttgtccactctatggaaatcctgatgacgttgcatactgcaaaggtcttctggagccgta
caaggacagctgccgcaaccccatcaacttctactactacaccatctcctgcgccttcgcccgctgtatgggtggagacgagcgag
cctcacacgtgctgcttgactacagggagacgtgcgctgctcccgaaactagaggaacctgcgttttgtctggacatactttctacga
tacatttgacaaagcaagataccaattccagggtccctgcaaggagattcttatggccgccgactgtttctggaacacttgggatgtg
aaggtttcacacaggaatgttgactcttacactgaagtagagaaagtacgaatcaggaaacaatcgactgtagtagaactcattgtt
gatgaaaacagattctggttggaggagaagcctgtccgtcccgtacagctctcagaacacttccatctactggcaagatggtga
catactgactacagccatcctacctgaagctctggtggtcaagttcaacttcaagcaactgctcgtcgtacatattagagatccattcg
atggtaagacttgcggtatttgcggtaactacaaccaggatttcagtgatgattcttttgatgctgaaggagcctgtgatctgacccccc
aacccaccgggatgcaccgaagaacagaaacctgaagctgaacgactctgcaatagtctcttcgccggtcaaagtgatcttgatc
agaaatgtaacgtgtgccacaagcctgaccgtgtcgaacgatgcatgtacgagtattgcctgaggggacaacagggtttctgtgac
cacgcatgggagttcaagaaagaatgctacataaagcatggagacaccctagaagtaccagatgaatgcaaaaagcgcgccgc
gccggacctcgacgtgcgcaagtgcctccctgcggccccggggcaaaggccgctgcttcgggcccaatatctgctgcgcggaag
agctgggctgcttcgtgggcaccgccgaagcgctgcgctgccaggaggagaactacctgccgtcgccctgccagtccggccagaag
gcgtgcgggagcggggccgctgcgcggtcttgggcctctgctgcagcccggacggctgccacgccgaccctgcctgcgacgcgg
aagccaccttctcccagcgctga
```

Vasopressin-Neurophysin-2 Mouse (nucleic acid sequence):

(SEQ ID NO: 255)

```
atgctcgccaggatgctcaacactacgctctccgcttgtttcctgagcctgctggccttctcctccgcctgctacttccagaactgcccaag
aggcggcaagaggTactgcgccactgttcattgccaggactgtccttacgaacctgatccaccaaacacagttccaacttcctgtga
```

-continued agctaaagaaggagaatgtattgatagcagctgtggcacctgcacgagagacatactatcagatggactgtgtgaaaataaacc aggaaaaacatgttgccgaatgtgtcagtatgtaattgaatgcagagtagaggccgcaggatggtttagaacattctatggaaaga gattccagttccaggaacctggtacatacgtgttgggtcaaggaaccaagggcggcgactggaaggtgtccatcaccctggagaa cctggatggaaccaaggggctgtgctgaccaagacaagactggaagtggctggagacatcattgacatcgctcaagctactga gaatcccatcactgtaaacggtggagctgaccctatcatcgccaacccgtacaccatcggcgaggtcaccatcgctgttgttgagat gccaggcttcaacatcaccgtcattgagttcttcaaactgatcgtgatcgacatcctcggaggaagatctgtaagaatcgccccaga cacagcaaacaaggaatgatctctggcctctgtggagatcttaaaatgatggaagatacagacttcacttcagatccagaacaa ctcgctattcagcctaagatcaaccaggagtttgacggttgtccactctatggaaatcctgatgacgttgcatactgcaaaggtcttct ggagccgtacaaggacagctgccgcaaccccatcaacttctactactacaccatctcctgcgccttcgcccgctgtatgggtggag acgagcgagcctcacacgtgctgcttgactacagggagacgtgcgctgctcccgaaactagaggaacctgcgttttgtctggacat actttctacgatacatttgacaaagcaagataccaattccagggtccctgcaaggagattcttatggccgccgactgtttctggaaca cttgggatgtgaaggtttcacacaggaatgttgactcttacactgaagtagagaaagtacgaatcaggaaacaatcgactgtagta gaactcattgttgatggaaaacagattctggttggaggagaagccgtgtccgtcccgtacagctctcagaacacttccatctactggc aagatggtgacatactgactacagccatcctacctgaagctctggtggtcaagttcaacttcaagcaactgctcgtcgtacatattag agatccattcgatggtaagacttgcggtatttgcggtaactacaaccaggatttcagtgatgattcttttgatgctgaaggagcctgtg atctgaccccaacccaccgggatgcaccgaagaacagaaacctgaagctgaacgactctgcaatagtctcttcgccggtcaaa gtgatcttgatcagaaatgtaacgtgtgccacaagcctgaccgtgtcgaacgatgcatgtacgagtattgcctgaggggacaacag ggtttctgtgaccacgcatgggagttcaagaaagaatgctacataaagcatggagacaccctagaagtaccagatgaatgcaaa <u>aagcgc</u>gccatctctgacatggagctgagacagtgtctccctgcggcccgggcggcaaaggacgctgcttcggaccaagcatctgc tgcgcggacgagctgggctgcttcgtgggcaccgccgaggcgctgcgctgccaggaggagaactacctgccctcgccctgccagtc cggccagaagccctgcgggagcggggccgctgcgccgccgtgggcatctgctgcagcgacgagagctgcgtggccgagcccg agtgccacgacggtttttttccgcctcacccgcgctcgggagccaagcaacgccacacagctggacggccctgctcgggcgctgctgc taaggctggtacagctggctgggacacgggagtccgtggattctgccaagcccccgggtctactga Vasopressin-Neurophysin-2 Human (nucleic acid sequence):

(SEQ ID NO: 256)

Atgcctgacaccatgctgccccgcctgcttcctcggcctactggccttctcctccgcgtgctacttccagaactgcccgaggggcggc<u>aa</u>

<u>gagg</u>Tactgcgccactgttcattgccaggactgtccttacgaacctgatccaccaaacacagttccaacttcctgtgaagctaaaga aggagaatgtattgatagcagctgtggcacctgcacgagagacatactatcagatggactgtgtgaaaataaaccaggaaaac atgttgccgaatgtgtcagtatgtaattgaatgcagagtagaggccgcaggatggtttagaacattctatggaaagagattccagttc caggaacctggtacatacgtgttgggtcaaggaaccaagggcggcgactggaaggtgtccatcaccctggagaacctggatgga accaaggggctgtgctgaccaagacaagactggaagtggctggagacatcattgacatcgctcaagctactgagaatcccatc actgtaaacggtggagctgaccctatcatcgccaacccgtacaccatcggcgaggtcaccatcgctgttgttgagatgccaggcttc aacataccgtcattgagttcttcaaactgatcgtgatcgacatcctcggaggaagatctgtaagaatcgccccagacacagcaaa caaaggaatgatctctggcctctgtggagatcttaaaatgatggaagatacagacttcacttcagatccagaacaactcgctattca gcctaagatcaaccaggagtttgacggttgtccactctatggaaatcctgatgacgttgcatactgcaaaggtcttctggagccgtac aaggacagctgccgcaaccccatcaacttctactactacaccatctcctgcgccttcgcccgctgtatgggtggagacgagcgagc ctcacacgtgctgcttgactacagggagacgtgcgctgctcccgaaactagaggaacctgcgttttgtctggacatactttctacgat acatttgacaaagcaagataccaattccagggtccctgcaaggagattcttatggccgccgactgtttctggaacacttgggatgtg aaggtttcacacaggaatgttgactcttacactgaagtagagaaagtacgaatcaggaaacaatcgactgtagtagaactcattgtt gatggaaaacagattctggttggaggagaagccgtgtccgtcccgttacagctctcagaacacttccatctactggcaagatggtga catactgactacagccatcctacctgaagctctggtggtcaagttcaacttcaagcaactgctcgtcgtacatattagagatccattcg -continued

```
atggtaagacttgcggtatttgcggtaactacaaccaggatttcagtgatgattcttttgatgctgaaggagcctgtgatctgacccccc
aacccaccgggatgcaccgaagaacagaaacctgaagctgaacgactctgcaatagtctcttcgccggtcaaagtgatcttgatc
agaaatgtaacgtgtgccacaagcctgaccgtgtcgaacgatgcatgtacgagtattgcctgaggggacaacagggtttctgtgac
cacgcatggagttcaagaaagaatgctacataaagcatggagacaccctagaagtaccagatgaatgcaaaaagcgcgccat
gtccgacctggagctgagacagtgcctccctgcggccccgggggcaaaggccgctgcttcgggcccagcatctgctgcgcggacg
agctgggctgcttcgtgggcacggctgaggcgctgcgctgccaggaggagaactacctgccgtcgccctgccagtccggccagaag
gcgtgcgggagcggggccgctgcgccgccttcggcgtttgctgcaacgacgagagctgcgtgaccgagcccgagtgccgcgag
ggctttcaccgccgcgcccgcgccagcgaccggagcaacgccacgcagctggacgggccggccggggccttgctgctgcggctg
gtgcagctggccggggcgcccgagcccttcgagcccgcccagcccgacgcctactga
```

Gonadotropin-releasing hormone (GnRH) Mouse (nucleic acid sequence):

(SEQ ID NO: 257)

```
Atgatcctcaaactgatggccggcattctactgctgactgtgtgtttggaaggctgctccagccagcactggtcctatgggttgcgccc
tgggggaaagagaTactgcgccactgttcattgccaggactgtccttacgaacctgatccaccaaacacagttccaacttcctgtga
agctaaagaaggagaatgtattgatagcagctgtggcacctgcacgagagacatactatcagatggactgtgtgaaaataaacc
aggaaaaacatgttgccgaatgtgtcagtatgtaattgaatgcagagtagaggccgcaggatggtttagaacattctatggaaaga
gattccagttccaggaacctggtacatacgtgtgggtcaaggaaccaagggcggcgactggaaggtgtccatcaccctggagaa
cctggatggaaccaaggggctgtgctgaccaagacaagactggaagtggctggagacatcattgacatcgctcaagctactga
gaatcccatcactgtaaacggtggagctgaccctatcatcgccaacccgtacaccatcggcgaggtcaccatcgctgttgttgagat
gccaggcttcaacatcaccgtcattgagttcttcaaactgatcgtgatcgacatcctcggaggaagatctgtaagaatcgccccaga
cacagcaaacaaaggaatgatctctggcctctgtggagatcttaaaatgatggaagatacagacttcacttcagatccagaacaa
ctcgctattcagcctaagatcaaccaggagtttgacggttgtccactctatggaaatcctgatgacgttgcatactgcaaaggtcttct
ggagccgtacaaggacagctgccgcaaccccatcaacttctactactacaccatctcctgcgccttcgcccgctgtatgggtggag
acgagcgagcctcacacgtgctgcttgactacagggagacgtgcgctgctcccgaaactagaggaacctgcgttttgtctggacat
actttctacgatacatttgacaaagcaagataccaattccagggtccctgcaaggagattcttatggccgccgactgtttctggaaca
cttgggatgtgaaggtttcacacaggaatgttgactcttacactgaagtagagaaagtacgaatcaggaaacaatcgactgtagta
gaactcattgttgatgaaaacagattctggttggaggagaagccgtgtccgtcccgtacagctctcagaacacttccatctactggc
aagatggtgacatactgactacagccatcctacctgaagctctggtggtcaagttcaacttcaagcaactgctcgtcgtacatattag
agatccattcgatggtaagacttgcggtatttgcggtaactacaaccaggatttcagtgatgattcttttgatgctgaaggagcctgtg
atctgacccccaacccaccgggatgcaccgaagaacagaaacctgaagctgaacgactctgcaatagtctcttcgccggtcaaa
gtgatcttgatcagaaatgtaacgtgtgccacaagcctgaccgtgtcgaacgatgcatgtacgagtattgcctgaggggacaacag
ggtttctgtgaccacgcatggagttcaagaaagaatgctacataaagcatggagacaccctagaagtaccagatgaatgcaaa
aagcgcaacactgaacacttggttgagtctttccaagagatgggcaaggaggtggatcaaatggcagaaccccagcacttcgaatgta
ctgtccactggccccgttcacccctcagggatctgcgaggagctctggaaagtctgattgaagaggaagccaggcagaagaagatgta
g
```

Gonadotropin-releasing hormone (GnRH) Human (nucleic acid sequence):

(SEQ ID NO: 258)

```
Atgaagccaattcaaaaactcctagctggccttattctactgacttggtgcgtggaaggctgctccagccagcactggtcctatggac
tgcgccctggaggaaagagaTactgcgccactgttcattgccaggactgtccttacgaacctgatccaccaaacacagttccaact
tcctgtgaagctaaagaaggagaatgtattgatagcagctgtggcacctgcacgagagacatactatcagatggactgtgtgaaa
ataaaccaggaaaaacatgttgccgaatgtgtcagtatgtaattgaatgcagagtagaggccgcaggatggtttagaacattctat
ggaaagagattccagttccaggaacctggtacatacgtgtgggtcaaggaaccaagggcggcgactggaaggtgtccatcacc
ctggagaacctggatggaaccaaggggctgtgctgaccaagacaagactggaagtggctggagacatcattgacatcgctcaa
gctactgagaatcccatcactgtaaacggtggagctgaccctatcatcgccaacccgtacaccatcggcgaggtcaccatcgctgtt
```

-continued gttgagatgccaggcttcaacatcaccgtcattgagttcttcaaactgatcgtgatcgacatcctcggaggaagatctgtaagaatcg ccccagacacagcaaacaaaggaatgatctctggcctctgtggagatcttaaaatgatggaagatacagacttcacttcagatcca gaacaactcgctattcagcctaagatcaaccaggagtttgacggttgtccactctatggaaatcctgatgacgttgcatactgcaaa ggtcttctggagccgtacaaggacagctgccgcaacccatcaacttctactactacaccatctcctgcgccttcgcccgctgtatgg gtggagacgagcgagcctcacacgtgctgcttgactacagggagacgtgcgctgctcccgaaactagaggaacctgcgttttgtct ggacatactttctacgatacatttgacaaagcaagataccaattccagggtccctgcaaggagattcttatggccgccgactgtttct ggaacacttgggatgtgaaggtttcacacaggaatgttgactcttacactgaagtagagaaagtacgaatcaggaaacaatcgac tgtagtagaactcattgttgatggaaaacagattctggttggaggagaagccgtgtccgtcccgtacagctctcagaacacttccatc tactggcaagatggtgacatactgactacagccatcctacctgaagctctggtggtcaagttcaacttcaagcaactgctcgtcgtac atattagagatccattcgatggtaagacttgcggtatttgcggtaactacaaccaggatttcagtgatgattcttttgatgctgaaggag cctgtgatctgaccccaacccaccgggatgcaccgaagaacagaaacctgaagctgaacgactctgcaatagtctcttcgccgg tcaaagtgatcttgatcagaaatgtaacgtgtgccacaagcctgaccgtgtcgaacgatgcatgtacgagtattgcctgagggggac aacagggtttctgtgaccacgcatgggagttcaagaaagaatgctacataaagcatggagacaccctagaagtaccagatgaat gcaaa<u>aagcgc</u>gatgccgaaaatttgattgattcttccaagagatagtcaaagaggttggtcaactggcagaaacccaacgcttcgaa tgcaccacgcaccagccacgttctcccctccgagacctgaaaggagctctggaaagtctgattgaagaggaaactgggcagaagaag atttaa Thyroid-stimulating hormone, beta subunit (TSHB) Mouse (nucleic acid sequence):

(SEQ ID NO: 259)

Atgagtgctgccgtcctcctctccgtgcttttgctcttgcttgtgggcaagcagcatccttttgtattcccactgagtatacaatgtacgtg gataggagagagtgtgcctactgcctgaccatcaacaccaccatctgtgctgggtattgtatgacacgggatatcaatggcaaact gtttcttcccaaatatgcactctctcaggatgtctgtacatacagagacttcatctacagaacggtggaaataccaggatgcccgcac catgttactccttatttctccttccctgtcgccataagctgcaagtgtggcaagtgtaatactgacaacagtgactgcatacacgaggct gtcagaaccaactactgcaccaagccgcagtctttc<u>tatctg</u>Tactgcgccactgttcattgccaggactgtccttacgaacctgatc caccaaacacagttccaacttcctgtgaagctaaagaaggagaatgtattgatagcagctgtggcacctgcacgagagacatact atcagatggactgtgtgaaaataaaccaggaaaaaacatgttgccgaatgtgtcagtatgtaattgaatgcagagtagaggccgca ggatggtttagaacattctatggaaagagattccagttccaggaacctggtacatacgtgtttgggtcaaggaaccaagggcggcg actggaaggtgtccatcaccctggagaacctggatggaaccaaggggctgtgctgaccaagacaagactggaagtggctgga gacatcattgacatcgctaagctactgagaatcccatcactgtaaacggtggagctgaccctatcatcgccaacccgtacaccatc ggcgaggtcaccatcgctgttgttgagatgccaggcttcaacatcaccgtcattgagttcttcaaactgatcgtgatcgacatcctcgg aggaagatctgtaagaatcgccccagacacagcaaacaaaggaatgatctctggcctctgtggagatcttaaaatgatggaagat acagacttcacttcagatccagaacaactcgctattcagcctaagatcaaccaggagtttgacggttgtccactctatggaaatcctg atgacgttgcatactgcaaaggtcttctggagccgtacaaggacagctgccgcaacccatcaacttctactactacaccatctcctg cgccttcgcccgctgtatgggtggagacgagcgagcctcacacgtgctgcttgactacagggagacgtgcgctgctcccgaaacta gaggaacctgcgttttgtctggacatactttctacgatacatttgacaaagcaagataccaattccagggtccctgcaaggagattctt atggccgccgactgtttctggaacacttgggatgtgaaggtttcacacaggaatgttgactcttacactgaagtagagaaagtacga atcaggaaacaatcgactgtagtagaactcattgttgatggaaaacagattctggttggaggagaagccgtgtccgtcccgtacag ctctcagaacacttccatctactggcaagatggtgacatactgactacagccatcctacctgaagctctggtggtcaagttcaacttca agcaactgctcgtcgtacatattagagatccattcgatggtaagacttgcggtatttgcggtaactacaaccaggatttcagtgatgat tcttttgatgctgaaggagcctgtgatctgaccccaacccaccgggatgcaccgaagaacagaaacctgaagctgaacgactct gcaatagtctcttcgccggtcaaagtgatcttgatcagaaatgtaacgtgtgccacaagcctgaccgtgtcgaacgatgcatgtacg -continued agtattgcctgaggggacaacagggtttctgtgaccacgcatgggagttcaagaaagaatgctacataaagcatggagacaccct
agaagtaccagatgaatgcaaa*tatctg*gggggattttctgtttaa Thyroid-stimulating hormone, beta subunit (TSHB) Human (nucleic acid sequence):
(SEQ ID NO: 260)
Atgactgctctcttctgatgtccatgcttttggccttacatgtgggcaagcgatgtctttttgtattccaactgagtatacaatgcacatcga
aaggagagagtgtgcttattgcctaaccatcaacaccaccatctgtgctggatattgtatgacacgggatatcaatggcaaactgtttcttc
ccaaatatgctctgtcccaggatgtttgcacatatagagacttcatctacaggactgtagaaataccaggatgcccactccatgttgctccc
tattttcctatcctgttgctttaagctgtaagtgtggcaagtgcaatactgactatagtgactgcatacatgaagccatcaagacaaactact
gtaccaaacctcagaagtctt*tatctg*Tactgcgccactgttcattgccaggactgtccttacgaacctgatccaccaaacacagttcca
acttcctgtgaagctaaagaaggagaatgtattgatagcagctgtggcacctgcacgagagacatactatcagatggactgtgtga
aaataaaccaggaaaaacatgttgccgaatgtgtcagtatgtaattgaatgcagagtagaggccgcaggatggtttagaacattct
atggaaagagattccagttccaggaacctggtacatacgtgtttgggtcaaggaaccaagggcggcgactggaaggtgtccatca
ccctggagaacctggatggaaccaaggggggctgtgctgaccaagacaagactggaagtggctggagacatcattgacatcgctc
aagctactgagaatcccatcactgtaaacggtggagctgaccctatcatcgccaacccgtacaccatcggcgaggtcaccatcgct
gttgttgagatgccaggcttcaacatcaccgtcattgagttcttcaaactgatcgtgatcgacatcctcggaggaagatctgtaagaat
cgccccagacacagcaaacaaaggaatgatctctggcctctgtggagatcttaaaatgatggaagatacagacttcacttcagatc
cagaacaactcgctattcagcctaagatcaaccaggagtttgacggttgtccactctatggaaatcctgatgacgttgcatactgcaa
aggtcttctggagccgtacaaggacagctgccgcaacccatcaacttctactactacaccatctcctgcgccttcgcccgctgtatg
ggtgagacgagcgagcctcacacgtgctgcttgactacaggggacgtgcgctgctcccgaaactagaggaacctgcgttttgtc
tggacatactttctacgatacatttgacaaagcaagataccaattccagggtccctgcaaggagattcttatggccgccgactgtttct
ggaacacttgggatgtgaaggtttcacacaggaatgttgactcttacactgaagtagagaaagtacgaatcaggaaacaatcgac
tgtagtagaactcattgttgatggaaaacagattctggttggaggagaagccgtgtccgtcccgtacagctctcagaacacttccatc
tactggcaagatggtgacatactgactacagccatcctacctgaagctctggtggtcaagttcaacttcaagcaactgctcgtcgtac
atattagagatccattcgatggtaagacttgcggtatttgcggtaactacaaccaggatttcagtgatgattcttttgatgctgaaggag
cctgtgatctgaccccaacccaccgggatgcaccgaagaacagaaacctgaagctgaacgactctgcaatagtctcttcgccgg
tcaaagtgatcttgatcagaaatgtaacgtgtgccacaagcctgaccgtgtcgaacgatgcatgtacgagtattgcctgaggggac
aacagggtttctgtgaccacgcatgggagttcaagaaagaatgctacataaagcatggagacaccctagaagtaccagatgaat
gcaaa*tatctg*gtaggattttctgtctaa Cortisol-releasing factor (CRF) Mouse (nucleic acid sequence):
(SEQ ID NO: 261)
Atgcggctgcggctgctggtgtccgcgggcatgctgctggtggctctgtcgtcctgcctgccttgcagggccctgctcagcaggggat
ccgtcccccgagcgccgcgggccccgcagcccttgaatttcttgcagccggagcagcccagcaacctcagccggttctgatccgca
tgggtgaagaatacttcctccgcctggggaatctcaacagaagtcccgctgctcggctgtccccaactccacgcccctcaccgcgggt
cgcggcagccgcccctcgcacgaccaggctgcggctaactttttccgcgtgttgctgcagcagctgcagatgcctcagcgctcgtcg
acagccgcgcggagccggccgaacgcggcgccgaggatgccctcggtggccaccaggggcgctggagagggag*aggcgg*T
actgcgccactgttcattgccaggactgtccttacgaacctgatccaccaaacacagttccaacttcctgtgaagctaaagaaggag
aatgtattgatagcagctgtggcacctgcacgagagacatactatcagatggactgtgtgaaaataaaccaggaaaaacatgttg
ccgaatgtgtcagtatgtaattgaatgcagagtagaggccgcaggatggtttagaacattctatggaaagagattccagttccagga
acctggtacatacgtgtttgggtcaaggaaccaagggcggcgactggaaggtgtccatcaccctggagaacctggatggaaccaa
ggggggctgtgctgaccaagacaagactggaagtggctggagacatcattgacatcgctcaagctactgagaatcccatcactgta
aacggtggagctgaccctatcatcgccaacccgtacaccatcggcgaggtcaccatcgctgttgttgagatgccaggcttcaacatc
accgtcattgagttcttcaaactgatcgtgatcgacatcctcggaggaagatctgtaagaatcgccccagacacagcaaacaaag

```
gaatgatctctggcctctgtggagatcttaaaatgatggaagatacagacttcacttcagatccagaacaactcgctattcagcctaa
gatcaaccaggagtttgacggttgtccactctatggaaatcctgatgacgttgcatactgcaaaggtcttctggagccgtacaagga
cagctgccgcaaccccatcaacttctactactacaccatctcctgcgccttcgcccgctgtatgggtggagacgagcgagcctcaca
cgtgctgcttgactacaggagacgtgcgctgctcccgaaactagaggaacctgcgttttgtctggacatactttctacgatacatttg
acaaagcaagataccaattccagggtcctgcaaggagattcttatggccgccgactgtttctggaacacttgggatgtgaaggttt
cacacaggaatgttgactcttacactgaagtagagaaagtacgaatcaggaaacaatcgactgtagtagaactcattgttgatgga
aaacagattctggttggaggagaagccgtgtccgtcccgtacagctctcagaacacttccatctactggcaagatggtgacatactg
actacagccatcctacctgaagctctggtggtcaagttcaacttcaagcaactgctcgtcgtacatattagagatccattcgatggtaa
gacttgcggtatttgcggtaactacaaccaggatttcagtgatgattcttttgatgctgaaggagcctgtgatctgaccccaacccac
cgggatgcaccgaagaacagaaacctgaagctgaacgactctgcaatagtctcttcgccggtcaaagtgatcttgatcagaaatgt
aacgtgtgccacaagcctgaccgtgtcgaacgatgcatgtacgagtattgcctgaggggacaacagggtttctgtgaccacgcatg
ggagttcaagaaagaatgctacataaagcatggagacaccctagaagtaccagatgaatgcaaaaggcggtcggaggagccg
cccatctctctggatctcaccttccaccttctgcgggaagtcttggaaatggcccgggcagagcagttagctcagcaagctcacagcaa
caggaaactgatggagattatcgggaaatga
```
Cortisol-releasing factor (CRF) Human (nucleic acid sequence): (SEQ ID NO: 262)
```
Atgcggctgccgctgcttgtgtccgcgggagtcctgctggtggctctcctgccctgcccgccatgcagggcgctcctgagccgcggg
ccggtcccgggagctcggcaggcgccgcagcaccctcagcccttggatttcttccagccgccgccgcagtccgagcagcccagca
gccgcaggctcggccggtcctgctccgcatgggagaggagtacttcctccgcctggggaacctcaacaagagcccggccgctcccc
tttcgccccgcctcctcgctcctcgccggaggcagcggcagccgccctctgccggaacaggcgaccgccaacttttttccgcgtgttgctg
cagcagctgctgctgcctcggcgctcgctcgacagccccgcggctctcgcggagcgcggcgctaggaatgccctcggcggccacc
aggaggcaccggagagagaaaggcggTactgcgccactgttcattgccaggactgtccttacgaacctgatccaccaaacacagt
tccaacttcctgtgaagctaaagaaggagaatgtattgatagcagctgtggcacctgcacgagagacatactatcagatggactgt
gtgaaaataaaccaggaaaaacatgttgccgaatgtgtcagtatgtaattgaatgcagagtagaggccgcaggatggtttagaac
attctatggaaagagattccagttccaggaacctggtacatacgtgttgggtcaaggaaccaagggcggcgactggaaggtgtcc
atcaccctggagaacctggatggaaccaagggggctgtgctgaccaagacaagactggaagtggctggagacatcattgacatc
gctcaagctactgagaatcccatcactgtaaacggtggagctgacctatcatcgccaacccgtacaccatcggcgaggtcaccat
cgctgttgttgagatgccaggcttcaacatcaccgtcattgagttcttcaaaactgatcgtgatcgacatcctcggaggaagatctgtaa
gaatcgccccagacacagcaaacaaaggaatgatctctggcctctgtggagatcttaaaatgatggaagatacagacttcacttca
gatccagaacaactcgctattcagcctaagatcaaccaggagtttgacggttgtccactctatggaaatcctgatgacgttgcatact
gcaaaggtcttctggagccgtacaaggacagctgccgcaaccccatcaacttctactactacaccatctcctgcgccttcgcccgct
gtatgggtggagacgagcgagcctcacacgtgctgcttgactacaggagacgtgcgctgctcccgaaactagaggaacctgcg
ttttgtctggacatactttctacgatacatttgacaaagcaagataccaattccagggtcctgcaaggagattcttatggccgccgac
tgtttctggaacacttgggatgtgaaggtttcacacaggaatgttgactcttacactgaagtagagaaagtacgaatcaggaaacaa
tcgactgtagtagaactcattgttgatggaaaacagattctggttggaggagaagccgtgtccgtcccgtacagctctcagaacactt
ccatctactggcaagatggtgacatactgactacagccatcctacctgaagctctggtggtcaagttcaacttcaagcaactgctcgt
cgtacatattagagatccattcgatggtaagacttgcggtatttgcggtaactacaaccaggatttcagtgatgattcttttgatgctga
aggagcctgtgatctgaccccaacccaccgggatgcaccgaagaacagaaacctgaagctgaacgactctgcaatagtctcttc
gccggtcaaagtgatcttgatcagaaatgtaacgtgtgccacaagcctgaccgtgtcgaacgatgcatgtacgagtattgcctgag
gggacaacagggtttctgtgaccacgcatgggagttcaagaaagaatgctacataaagcatggagacaccctagaagtaccag
atgaatgcaaaaggcggtccgaggagcctccatctccctggatctcaccttccaccttctccgggaagtcttggaaatggccagggc
cgagcagttagcacagcaagctccagcaacaggaaactcatggagattattgggaataa
```

-continued

Atrial natriuretic peptide (ANP) Mouse (nucleic acid sequence)

(SEQ ID NO: 263)

Atgggctccttctccatcaccctgggcttcttcctcgtcttggccttttggcttccaggccatattggagcaaatcctgtgtacagtgcggtg tccaacacagatctgatggatttcaagaacctgctagaccacctggaggagaagatgccggtagaagatgaggtcatgccccgcag gccctgagtgagcagactgaggaagcaggggccgcacttagctccctccccgaggtgcctccctggactggggaggtcaacccacc tctgagagacggcagtgctctagggcgcagccctgggacccctccgatagatctgccctcttgaaaagcaaactgagggctctgctc gctggccct<u>cggagc</u>Tactgcgccactgttcattgccaggactgtccttacgaacctgatccaccaaacacagttccaacttcctgtg aagctaaagaaggagaatgtattgatagcagctgtggcacctgcacgagagacatactatcagatggactgtgtgaaaataaac caggaaaaacatgttgccgaatgtgtcagtatgtaattgaatgcagagtagaggccgcaggatggtttagaacattctatggaaag agattccagttccaggaacctggtacatacgtgttgggtcaaggaaccaagggcggcgactggaaggtgtccatcaccctggaga acctggatggaaccaagggggctgtgctgaccaagacaagactggaagtggctgagacatcattgacatcgctcaagctactg agaatcccatcactgtaaacggtggagctgaccctatcatcgccaacccgtacaccatcggcgaggtcaccatcgctgttgttgag atgccaggcttcaacatcaccgtcattgagttcttcaaactgatcgtgatcgacgtcctcggaggaagatctgtaagaatcgcccca gacacagcaaacaaggaatgatctctggcctctgtggagatcttaaaatgatggaagatacagacttcacttcagatccagaac aactcgctattcagcctaagatcaaccaggagtttgacggttgtccactctatggaaatcctgatgacgttgcatactgcaaaggtctt ctggagccgtacaaggacagctgccgcaacccatcaacttctactactacaccatctcctgcgccttcgcccgctgtatgggtgga gacgagcgagcctcacacgtgctgcttgactacagggagacgtgcgctgctcccgaaactagaggaacctgcgttttgtctggaca tactttctacgatacatttgacaaagcaagataccaattccagggtccctgcaaggagattcttatggccgccgactgtttctggaac acttgggatgtgaaggtttcacacaggaatgttgactcttacactgaagtagagaaagtacgaatcaggaaacaatcgactgtagt agaactcattgttgatggaaaacagattctggttggaggagaagccgtgtccgtcccgtacagctctcagaacacttccatctactg gcaagatggtgacatactgactacagccatcctacctgaagctctggtggtcaagttcaacttcaagcaactgctcgtcgtacatatt agagatccattcgatggtaagacttgcggtatttgcggtaactacaaccaggatttcagtgatgattcttttgatgctgaaggagcctg tgatctgaccccaacccaccgggatgcaccgaagaacagaaacctgaagctgaacgactctgcaatagtctcttcgccggtcaa agtgatcttgatcagaaatgtaacgtgtgccaacaagcctgaccgtgtcgaacgatgcatgtacgagtattgctgaggggacaaca gggtttctgtaccacgcatgggagttcaagaaagaatgctacataaagcatggagacaccctagaagtaccagatgaatgcaa a<u>cggagc</u>ctacgaagatccagctgcttcgggggtaggattgacaggattggagcccagagtggactaggctgcaacagcttccggta ccgaagataa Atrial natriuretic peptide (ANP) Human (nucleic acid sequence):

(SEQ ID NO: 264)

atgagctccttctccaccaccaccgtgagcttcctcctttttactggcattccagctcctaggtcagaccagagctaatcccatgtacaatgc cgtgtccaacgcagacctgatggatttcaagaatttgctggaccatttggaagaaaagatgcctttagaagatgaggtcgtgccccaca agtgctcagtgagccgaatgaagaagcgggggctgctctcagcccctccctgaggtgcctccctggaccggggaagtcagcccag cccagagagatggaggtgccctcgggcggggcccctgggactcctctgatcgatctgccctcctaaaaagcaagctgagggcgctgc tcactgcccct<u>cggagc</u>Tactgcgccactgttcattgccaggactgtccttacgaacctgatccaccaaacacagttccaacttcctgt gaagctaaagaaggagaatgtattgatagcagctgtggcacctgcacgagagacatactatcagatggactgtgtgaaaataaa ccaggaaaaacatgttgccgaatgtgtcagtatgtaattgaatgcagagtagaggccgcaggatggtttagaacattctatggaaa gagattccagttccaggaacctggtacatacgtgttgggtcaaggaaccaagggcggcgactggaaggtgtccatcaccctggag aacctggatggaaccaagggggctgtgctgaccaagacaagactggaagtggctgagacatcattgacatcgctcaagctact gagaatcccatcactgtaaacggtggagctgaccctatcatcgccaacccgtacaccatcggcgaggtcaccatcgctgttgttga gatgccaggcttcaacatcaccgtcattgagttcttcaaactgatcgtgatcgacatcctcggaggaagatctgtaagaatcgcccc agacacagcaaacaaggaatgatctctggcctctgtggagatcttaaaatgatggaagatacagacttcacttcagatccagaa caactcgctattcagcctaagatcaaccaggagtttgacggttgtccactctatggaaatcctgatgacgttgcatactgcaaaggtc -continued ttctggagccgtacaaggacagctgccgcaacccatcaacttctactactacaccatctcctgcgccttcgcccgctgtatgggtgg
agacgagcgagcctcacacgtgctgcttgactacaggggagacgtgcgctgctcccgaaactagaggaacctgcgttttgtctggac
atactttctacgatacatttgacaaagcaagataccaattccagggtccctgcaaggagattcttatggccgccgactgtttctggaa
cacttgggatgtgaaggtttcacacaggaatgttgactcttacactgaagtagagaaagtacgaatcaggaaacaatcgactgtag
tagaactcattgttgatggaaaacagattctggttggaggagaagccgtgtccgtcccgtacagctctcagaacacttccatctactg
gcaagatggtgacatactgactacagccatcctacctgaagctctggtggtcaagttcaacttcaagcaactgctcgtcgtacatatt
agagatccattcgatggtaagacttgcggtatttgcggtaactacaaccaggatttcagtgatgattctttgatgctgaaggagcctg
tgatctgaccccaacccaccgggatgcaccgaagaacagaaacctgaagctgaacgactctgcaatagtctcttcgccggtcaa
agtgatcttgatcagaaatgtaacgtgtgccacaagcctgaccgtgtcgaacgatgcatgtacgagtattgcctgaggggacaaca
gggtttctgtgaccacgcatgggagttcaagaaagatgctacataaagcatggagacacctagaagtaccagatgaatgcaa
acggagcctgcggagatccagctgcttcgggggcaggatggacaggattggagcccagagcggactgggctgtaacagcttccggt
actga Brain natriuretic peptide (BNP) Mouse (nucleic acid sequence):
(SEQ ID NO: 265)
atggatctcctgaaggtgctgtcccagatgattctgtttctgcttttcctttatctgtcaccgctgggaggtcactcctatcctctgggaagtcc
tagccagtctccagagcaattcaagatgcagaagctgctggagctgataagagaaaagtcggaggaaatggcccagagacagctctt
gaaggaccaaggcctcacaaaagaacacccaaaaagagtccttcggtctTactgcgccactgttcattgccaggactgtccttacga
acctgatccaccaaacacagttccaacttcctgtgaagctaaagaaggagaatgtattgatagcagctgtggcacctgcacgaga
gacatactatcagatggactgtgtgaaaataaaccaggaaaaacatgttgccgaatgtgtcagtatgtaattgaatgcagagtaga
ggccgcaggatggtttagaacattctatgaaagagattccagttccaggaactggtacatacgtgttgggtcaaggaaccaagg
gcggcgactggaaggtgtccatcaccctggagaacctggatggaaccaaggggctgtgctgaccaagacaagactggaagtg
gctggagacatcattgacatcgctcaagctactgagaatcccatcactgtaaacggtggagctgaccctatcatcgccaacccgta
caccatcggcgaggtcaccatcgctgttgttgagatgccaggcttcaacatcaccgtcattgagttcttcaaactgatcgtgatcgac
atcctcggaggaagatctgtaagaatcgccccagacacagcaaacaaaggaatgatctctggcctctgtggagatcttaaaatga
tggaagatacagacttcacttcagatccagaacaactcgctattcagcctaagatcaaccaggagtttgacggttgtccactctatgg
aaatcctgatgacgttgcatactgcaaaggtcttctggagccgtacaaggacagctgccgcaacccatcaacttctactactacac
catctcctgcgccttcgcccgctgtatgggtggagacgagcgagcctcacacgtgctgcttgactacaggggagacgtgcgctgctcc
cgaaactagaggaacctgcgttttgtctggacatactttctacgatacatttgacaaagcaagataccaattccagggtccctgcaa
ggagattcttatggccgccgactgtttctggaacacttgggatgtgaaggtttcacacaggaatgttgactcttacactgaagtagag
aaagtacgaatcaggaaacaatcgactgtagtagaactcattgttgatggaaaacagattctggttggaggagaagccgtgtccgt
cccgtacagctctcagaacacttccatctactggcaagatggtgacatactgactacagccatcctacctgaagctctggtggtcaa
gttcaacttcaagcaactgctcgtcgtacatattagagatccattcgatggtaagacttgcggtatttgcggtaactacaaccaggatt
tcagtgatgattctttgatgctgaaggagcctgtgatctgaccccaacccaccgggatgcaccgaagaacagaaacctgaagct
gaacgactctgcaatagtctcttcgccggtcaaagtgatcttgatcagaaatgtaacgtgtgccacaagcctgaccgtgtcgaacga
tgcatgtacgagtattgcctgaggggacaacagggtttctgtgaccacgcatgggagttcaagaaagatgctacataaagcatg
gagacacctagaagtaccagatgaatgcaaacggtctcaaggcagcaccctccgggtccagcagagacctcaaaattccaaggt
gacacatatctcaagctgctttgggcacaagatagaccggatcggatccgtcagtcgtttgggctgtaacgcactgaagttgttgtag Brain natriuretic peptide (BNP) Human (nucleic acid sequence):
(SEQ ID NO: 266)
Atggatcccagacagcaccttcccgggcgctcctgctcctgctcttcttgcatctggctttcctggaggtcgttcccaccgctgggc
agccccggttcagcctcggacttggaaacgtccgggttacaggagcagcgcaaccaatttgcagggcaaactgtcggagctgcaggtg
gagcagacatccctggagcccctccagagagagcccccgtcccacaggtgtctggaagtcccggggaggtagccaccgagggcatcc
gtgggcaccgcaaaatggtcctctacaccctgcggggcaccacgaagcTactgcgccactgttcattgccaggactgtccttacgaac -continued ctgatccaccaaacacagttccaacttcctgtgaagctaaagaaggagaatgtattgatagcagctgtggcacctgcacgagaga
catactatcagatggactgtgtgaaaataaaccaggaaaaacatgttgccgaatgtgtcagtatgtaattgaatgcagagtagagg
ccgcaggatggtttagaacattctatggaaagagattccagttccaggaacctggtacatacgtgtttgggtcaaggaaccaagggc
ggcgactggaaggtgtccatcaccctggagaacctggatggaaccaaggggctgtgctgaccaagacaagactggaagtggc
tggagacatcattgacatcgctcaagctactgagaatcccatcactgtaaacggtggagctgaccctatcatcgccaacccgtaca
ccatcggcgaggtcaccatcgctgttgttgagatgccaggcttcaacatcaccgtcattgagttcttcaaactgatcgtgatcgacatc
ctcggaggaagatctgtaagaatcgccccagacacagcaaacaaggaatgatctctggcctctgtggagatcttaaaatgatgg
aagatacagacttcacttcagatccgaacaactcgctattcagcctaagatcaaccaggagtttgacggttgtccactctatggaa
atcctgatgacgttgcatactgcaaaggtcttctggagccgtacaaggacagctgccgcaaccccatcaacttctactactacacca
tctcctgcgccttcgcccgctgtatgggtggagacgagcgagcctcacacgtgctgcttgactacagggagacgtgcgctgctcccg
aaactagaggaacctgcgttttgtctggacatactttctacgatacatttgacaaagcaagataccaattccagggtccctgcaagg
agattcttatggccgccgactgtttctggaacacttgggatgtgaaggtttcacacaggaatgttgactcttacactgaagtagagaa
agtacgaatcaggaaacaatcgactgtagtagaactcattgttgatggaaaacagattctggttggaggagaagccgtgtccgtcc
cgtacagctctcagaacacttccatctactggcaagatggtgacatactgactacagccatcctacctgaagctctggtggtcaagtt
caacttcaagcaactgctcgtcgtacatattagagatccattcgatggtaagacttgcggtatttgcggtaactacaaccaggatttca
gtgatgattcttttgatgctgaaggagcctgtgatctgaccccaacccaccgggatgcaccgaagaacagaaacctgaagctga
acgactctgcaatagtctcttcgccggtcaaagtgatcttgatcagaaatgtaacgtgtgccacaagcctgaccgtgtcgaacgatg
catgtacgagtattgcctgaggggacaacagggtttctgtgaccacgcatgggagttcaagaaagaatgctacataaagcatgga
gacaccctagaagtaccagatgaatgcaa<u>acgaagc</u>cgaagccccaagatggtgcaagggtctggctgctttgggaggaagatgg
accggatcagctcctccagtggcctgggctgcaaagtgctgaggcggcattaa Renin Mouse (nucleic acid sequence):
(SEQ ID NO: 267)
Atggacagaaggaggatgcctctctgggcactcttgttgctctggagtccttgcaccttcagtctcccaacacgcaccgctacctttgaa
cgaatcccgctcaagaaaatgccttctgtccgggaaatcctggaggagcggggagtggacatgaccaggctcagtgctgaatggggc
gtattcaca<u>aagagg</u>Tactgcgccactgttcattgccaggactgtccttacgaacctgatccaccaaacacagttccaacttcctgtg
aagctaaagaaggagaatgtattgatagcagctgtggcacctgcacgagagacatactatcagatggactgtgtgaaaataaac
caggaaaaacatgttgccgaatgtgtcagtatgtaattgaatgcagagtagaggccgcaggatggtttagaacattctatggaaag
agattccagttccaggaacctggtacatacgtgtttgggtcaaggaaccaaggggcggcgactggaaggtgtccatcaccctggaga
acctggatggaaccaaggggctgtgctgaccaagacaagactggaagtggctggagacatcattgacatcgctcaagctactg
agaatcccatcactgtaaacggtggagctgaccctatcatcgccaacccgtacaccatcggcgaggtcaccatcgctgttgttgag
atgccaggcttcaacatcaccgtcattgagttcttcaaactgatcgtgatcgacatcctcggaggaagatctgtaagaatcgcccca
gacacagcaaacaaggaatgatctctggcctctgtggagatcttaaaatgatggaagatacagacttcacttcagatccagaac
aactcgctattcagcctaagatcaaccaggagtttgacggttgtccactctatggaaatcctgatgacgttgcatactgcaaaggtctt
ctggagccgtacaaggacagctgccgcaaccccatcaacttctactactacaccatctcctgcgccttcgcccgctgtatgggtgga
gacgagcgagcctcacacgtgctgcttgactacagggagacgtgcgctgctcccgaaactagaggaacctgcgttttgtctggaca
tactttctacgatacatttgacaaagcaagataccaattccagggtccctgcaaggagattcttatggccgccgactgtttctggaac
acttgggatgtgaaggtttcacacaggaatgttgactcttacactgaagtagagaaagtacgaatcaggaaacaatcgactgtagt
agaactcattgttgatggaaaacagattctggttggaggagaagccgtgtccgtcccgtacagctctcagaacacttccatctactg
gcaagatggtgacatactgactacagccatcctacctgaagctctggtggtcaagttcaacttcaagcaactgctcgtcgtacatatt
agagatccattcgatggtaagacttgcggtatttgcggtaactacaaccaggatttcagtgatgattcttttgatgctgaaggagcctg
tgatctgaccccaacccaccgggatgcaccgaagaacagaaacctgaagctgaacgactctgcaatagtctcttcgccggtcaa

```
agtgatcttgatcagaaatgtaacgtgtgccacaagcctgaccgtgtcgaacgatgcatgtacgagtattgcctgaggggacaaca
gggtttctgtgaccacgcatgggagttcaagaaagaatgctacataaagcatggagacaccctagaagtaccagatgaatgcaa
aaagaggccttccttgaccaatcttacctcccccgtggtcctcaccaactacctgaatacccagtactacggcgagattggcatcggtac
cccaccccagaccttcaaagtcatctttgacacgggttcagccaacctctggtgccctccaccaagtgcagccgcctctaccttgcttgt
gggattcacagcctctatgagtcctctgactcctccagctacatggagaacgggtccgacttcaccatccactacggatcagggagagt
caaaggtttcctcagccaggactcggtgactgtgggtggaatcactgtgacacagacctttggagaggtcaccgagctgcccctgatcc
ctttcatgctggccaagtttgacggtgttctaggcatgggctttcccgctcaggccgttggcggggttacccctgtctttgaccacattctct
cccaggggggtgctaaaggaggaagtgttctctgtctactacaacaggggttcccacctgctgggggggcgaggtggtgctaggaggta
gcgacccgcagcattatcaaggcaattttcactatgtgagcatcagcaagactgactcctggcagatcacgatgaagggggtgtctgtg
gggtcttccaccctgctatgtgaagaaggctgtgcggtagtggtggacactggttcatccttctctcggctcctacgagctccctgaagtt
gatcatgcaagccctgggagccaaggagaagagaatagaagaatatgttgtgaactgtagccaggtgccccaccctccccgacatttcc
tttgacctgggaggcagggcctacacactcagcagtacggactacgtgctacagtatcccaacaggagagacaagctgtgcacactg
gctctccatgccatggacatccccaccacccactgggcctgtctgggtcctgggtgccaccttcatccgcaagttctatacagagtttgatc
ggcataacaatcgcattggattcgccttggcccgctaa
```

Renin Human (nucleic acid sequence):

(SEQ ID NO: 268)

```
Atggatggatggagaaggatgcctcgctggggactgctgctgctgctctggggctcctgtacctttggtctcccgacagacaccacca
cctttaaacggTactgcgccactgttcattgccaggactgtccttacgaacctgatccaccaaacacagttccaacttcctgtgaagct
aaagaaggagaatgtattgatagcagctgtggcacctgcacgagagacatactatcagatggactgtgtgaaaataaaccagga
aaaacatgttgccgaatgtgtcagtatgtaattgaatgcagagtagaggccgcaggatggtttagaacattctatggaaagagattc
cagttccaggaacctggtacatacgtgttgggtcaaggaaccaagggcggcgactggaaggtgtccatcaccctggagaacctg
gatggaaccaaggggggctgtgctgaccaagacaagactggaagtggctggagacatcattgacatcgctcaagctactgagaat
cccatcactgtaaacggtggagctgaccctatcatcgccaacccgtacaccatcggcgaggtcaccatcgctgttgttgagatgcca
ggcttcaacatcaccgtcattgagttcttcaaactgatcgtgatcgacatcctcggaggaagatctgtaagaatcgcccccagacaca
gcaaacaaggaatgatctctggcctctgtggagatcttaaaatgatggaagatacagacttcacttcagatccagaacaactcgc
tattcagcctaagatcaaccaggagtttgacggttgtccactctatggaaatcctgatgacgttgcatactgcaaaggtcttctggagc
cgtacaaggacagctgccgcaaccccatcaacttctactactacaccatctcctgcgccttcgcccgctgtatgggtggagacgagc
gagcctcacacgtgctgcttgactacagggagacgtgcgctgctcccgaaactagaggaacctgcgttttgtctggacatactttcta
cgatacatttgacaaagcaagataccaattccagggtccctgcaaggagattcttatggccgccgactgtttctggaacacttggga
tgtgaaggtttcacacaggaatgttgactcttacactgaagtagagaaagtacgaatcaggaaacaatcgactgtagtagaactca
ttgttgatggaaaacagattctggttggaggagaagccgtgtccgtcccgtacagctctcagaacacttccatctactggcaagatg
gtgacatactgactacagccatcctacctgaagctctggtggtcaagttcaacttcaagcaactgctcgtcgtacatattagagatcc
attcgatggtaagacttgcggtatttgcggtaactacaaccaggatttcagtgatgattcttttgatgctgaaggagcctgtgatctgac
ccccaacccaccggatgcaccgaagaacagaaacctgaagctgaacgactctgcaatagtctcttcgccggtcaaagtgatctt
gatcagaaatgtaacgtgtgccacaagcctgaccgtgtcgaacgatgcatgtacgagtattgcctgaggggacaacagggtttctg
tgaccacgcatgggagttcaagaaagaatgctacataaagcatggagacaccctagaagtaccagatgaatgcaaaaacgga
tcttcctcaagagaatgccctcaatccgagaaagcctgaaggaacgaggtgtggacatggccaggcttggtcccgagtggagccaac
ccatgaagaggctgacacttggcaacaccacctcctccgtgatcctcaccaactacatggacacccagtactatggcgagattggcatc
ggcaccccaccccagaccttcaaagtcgtctttgacactggttcgtccaatgtttgggtgcctcctccaagtgcagccgtctctacactg
cctgtgtgtatcacaagctcttcgatgcttcggattcctccagctacaagcacaatggaacagaactcacccctccgctattcaacagggac
agtcagtggcttttctcagccaggacatcatcaccgtgggtggaatcacggtgacacagatgtttggagaggtcacggagatgcccgcct
taccctttcatgctggccgagtttgatgggggttgtgggcatgggcttcattgaacaggccattggcagggtcacccctatcttcgacaacat
```

-continued catctcccaaggggtgctaaaagaggacgtcttctctttctactacaacagagattccgagaattcccaatcgctgggaggacagattgt gctgggaggcagcgaccccagcattacgaagggaatttccactatatcaacctcatcaagactggtgtctggcagattcaaatgaagg gggtgtctgtggggtcatccttccagctctgtgaagacggctgcctggcattggtagacaccggtgcatcctacatctcaggttctaccag ctccatagaaagctcatggaggccttgggagccaagaagaggctgtttgattatgtcgtgaagtgtaacgagggccctacactcccccg acatctcttccacctgggaggcaaagaatacacgctcaccagcgcggactatgtatttcaggaatcctacagtagtaaaaagctgtgca cactggccatccacgccatggatatcccgccacccactggacccacctgggccctgggggccaccttcatccgaaagttctacacaga gtttgatcggcgtaacaaccgcattggcttcgccttggcccgctga Galanin Mouse (nucleic acid sequence): (SEQ ID NO: 269)

Atggccagaggcagcgttatcctgctaggctggctcctgttggttgtgaccctgtcagccactctgggacttgggatgcctgcaaagga gaagagaggt*Tactgcgccactgttcattgccaggactgtccttacgaacctgatccaccaaacacagttccaacttcctgtgaagct*

*aaagaaggagaatgtattgatagcagctgtggcacctgcacgagagacatactatcagatggactgtgtgaaaataaaccagga*

*aaaacatgttgccgaatgtgtcagtatgtaattgaatgcagagtagaggccgcaggatggtttagaacattctatggaaagagattc*

*cagttccaggaacctggtacatacgtgttgggtcaaggaaccaagggcggcgactggaaggtgtccatcaccctggagaacctg*

*gatggaaccaagggggctgtgctgaccaagacaagactggaagtggctgagacatcattgacatcgctcaagctactgagaat*

*cccatcactgtaaacggtggagctgaccctatcatcgccaacccgtacaccatcggcgaggtcaccatcgctgttgttgagatgcca*

*ggcttcaacatcaccgtcattgagttcttcaaactgatcgtgatcgacatcctcggaggaagatctgtaagaatcgcccagacaca*

*gcaaacaaggaatgatctctggcctctgtggagatcttaaaatgatggaagatacagacttcacttcagatccagaacaactcgc*

*tattcagcctaagatcaaccaggagtttgacggttgtccactctatggaaatcctgatgacgttgcatactgcaaaggtcttctggagc*

*cgtacaaggacagctgccgcaaccccatcaacttctactactacaccatctcctgcgccttcgcccgctgtatgggtggagacgagc*

*gagcctcacacgtgctgcttgactacagggagacgtgcgctgctcccgaaactagaggaacctgcgttttgtctggacatactttcta*

*cgatacatttgacaaagcaagataccaattccagggtccctgcaaggagattcttatggccgccgactgtttctggaacacttggga*

*tgtgaaggtttcacacaggaatgttgactcttacactgaagtagagaaagtacgaatcaggaaacaatcgactgtagtagaactca*

*ttgttgatggaaaacagattctggttggaggagaagccgtgtccgtcccgtacagctctcagaacacttccatctactggcaagatg*

*gtgacatactgactacagccatcctacctgaagctctggtggtcaagttcaacttcaagcaactgctcgtcgtacatattagagatcc*

*attcgatggtaagacttgcggtattttgcggtaactacaaccaggatttcagtgatgattcttttgatgctgaaggagcctgtgatctgac*

*ccccaacccaccgggatgcaccgaagaacagaaacctgaagctgaacgactctgcaatagtctcttcgccggtcaaagtgatctt*

*gatcagaaatgtaacgtgtgccacaagcctgaccgtgtcgaacgatgcatgtacgagtattgcctgaggggacaacagggtttctg*

*tgaccacgcatgggagttcaagaaagaatgctacataaagcatggagacaccctagaagtaccagatgaatgcaaa*aagagag gttggaccctgaacagcgctggctaccttctgggcccacatgccattgacaaccacagatcatttagcgacaagcatggcctcacaggc aagagggagttacaactggaggtggaggaaggagaccaggaagtgttgatgtgcccctgcctgagagcaacattgtccgcactata atggagtttctcagtttcttgcaccttaaagaggccggggccctcgacagcctgcctggcatccccttggccacctcctcagaagaccta gagaagtcctga Galanin Human (nucleic acid sequence): (SEQ ID NO: 270)

Atggcccgaggcagcgccctcctgctcgcctccctcctcctcgccgcgggccctttctgcctctgcggggctctggtcgccggccaag gaaaaacgaggc*Tactgcgccactgttcattgccaggactgtccttacgaacctgatccaccaaacacagttccaacttcctgtgaa*

*gctaaagaaggagaatgtattgatagcagctgtggcacctgcacgagagacatactatcagatggactgtgtgaaaataaacca*

*ggaaaaacatgttgccgaatgtgtcagtatgtaattgaatgcagagtagaggccgcaggatggtttagaacattctatggaaagag*

*attccagttccaggaacctggtacatacgtgttgggtcaaggaaccaagggcggcgactggaaggtgtccatcaccctggagaac*

*ctggatggaaccaagggggctgtgctgaccaagacaagactggaagtggctgagacatcattgacatcgctcaagctactgag*

*aatcccatcactgtaaacggtggagctgaccctatcatcgccaacccgtacaccatcggcgaggtcaccatcgctgttgttgagatg* ccaggcttcaacatcaccgtcattgagttcttcaaactgatcgtgatcgacatcctcggaggaagatctgtaagaatcgccccagac acagcaaacaaaggaatgatctctggcctctgtggagatcttaaaatgatggaagatacagacttcacttcagatccagaacaact cgctattcagcctaagatcaaccaggagtttgacggttgtccactctatggaaatcctgatgacgttgcatactgcaaaggtcttctgg agccgtacaaggacagctgccgcaacccctcaacttctactactacaccatctcctgcgccttcgcccgctgtatgggtggagacg agcgagcctcacacgtgctgcttgactacagggagacgtgcgctgctcccgaaactagaggaacctgcgttttgtctggacatactt tctacgatacatttgacaaagcaagataccaattccagggtccctgcaaggagattcttatggccgccgactgtttctggaacacttg ggatgtgaaggtttcacacaggaatgttgactcttacactgaagtagagaaagtacgaatcaggaaacaatcgactgtagtagaa ctcattgttgatggaaaacagattctggttggaggagaagccgtgtccgtcccgtacagctctcagaacacttccatctactggcaag atggtgacatactgactacagccatcctacctgaagctctggtggtcaagttcaacttcaagcaactgctcgtcgtacatattagaga tccattcgatggtaagacttgcggtatttgcggtaactacaaccaggatttcagtgatgattcttttgatgctgaaggagcctgtgatct gaccccaaccaccgggatgcaccgaagaacagaaacctgaagctgaacgactctgcaatagtctcttcgccggtcaaagtga tcttgatcagaaatgtaacgtgtgccacaagcctgaccgtgtcgaacgatgcatgtacgagtattgcctgagggacaacagggttt ctgtgaccacgcatgggagttcaagaaagaatgctacataaagcatggagacaccctagaagtaccagatgaatgcaaaaac gaggctggaccctgaacagcgcgggctacctgctgggcccacatgccgttggcaaccacaggtcattcagcgacaagaatggcctca ccagcaagcgggagctgcgccccgaagatgacatgaaaccaggaagctttgacaggtccatacctgaaaacaatatcatgcgcacaa tcattgagtttctgtctttcttgcatctcaaagaggccggtgccctcgaccgcctcctggatctccccgccgcagcctcctcagaagacatc gagcggtcctga Orexin Mouse (nucleic acid sequence):

(SEQ ID NO: 271)

Atgaactttccttctacaaaggttccctgggccgccgtgacgctgctgctgctgctactgctgccgccggcgctgctgtcgcttgggt ggacgcacagcctctgcccgactgctgtcgccagaagacgtgttcctgccgtctctacgaactgttgcacggagctggcaaccacg ctgcgggtatcctgactctgggaaagcggcggcctggacctccaggcctccagggacggctgcagcgcctccttcaggccaacgg taaccacgcagctggcatcctgaccatgggccgccgcTactgcgccactgttcattgccaggactgtccttacgaacctgatccacc aaacacagttccaacttcctgtgaagctaaagaaggagaatgtattgatagcagctgtggcacctgcacgagagacatactatca gatggactgtgtgaaaataaaccaggaaaaacatgttgccgaatgtgtcagtatgtaattgaatgcagagtagaggccgcaggat ggtttagaacattctatggaaagagattccagttccaggaacctggtacatacgtgttgggtcaaggaaccaagggcggcgactgg aaggtgtccatcaccctggagaacctggatgaaccaaggggggctgtgctgaccaagacaagactggaagtggctggagacat cattgacatcgctcaagctactgagaatcccatcactgtaaacggtggagctgaccctatcatcgccaacccgtacaccatcggcg aggtcaccatcgctgttgttgagatgccaggcttcaacatcaccgtcattgagttcttcaaactgatcgtgatcgacatcctcggagga agatctgtaagaatcgccccagacacagcaaacaaaggaatgatctctggcctctgtggagatcttaaaatgatggaagatacag acttcacttcagatccagaacaactcgctattcagcctaagatcaaccaggagtttgacggttgtccactctatggaaatcctgatga cgttgcatactgcaaaggtcttctggagccgtacaaggacagctgccgcaacccctcaacttctactactacaccatctcctgcgc cttcgcccgctgtatgggtggagacgagcgagcctcacacgtgctgcttgactacagggagacgtgcgctgctcccgaaactaga ggaacctgcgttttgtctggacatactttctacgatacatttgacaaagcaagataccaattccagggtccctgcaaggagattcttat ggccgccgactgtttctggaacacttgggatgtgaaggtttcacacaggaatgttgactcttacactgaagtagagaaagtacgaat caggaaacaatcgactgtagtagaactcattgttgatggaaaacagattctggttggaggagaagccgtgtccgtcccgtacagct ctcagaacacttccatctactggcaagatggtgacatactgactacagccatcctacctgaagctctggtggtcaagttcaacttcaa gcaactgctcgtcgtacatattagagatccattcgatggtaagacttgcggtatttgcggtaactacaaccaggatttcagtgatgatt cttttgatgctgaaggagcctgtgatctgaccccaacccaccgggatgcaccgaagaacagaaacctgaagctgaacgactctg caatagtctcttcgccggtcaaagtgatcttgatcagaaatgtaacgtgtgccacaagcctgaccgtgtcgaacgatgcatgtacga gtattgcctgagggacaacagggtttctgtgaccacgcatgggagttcaagaaagaatgctacataaagcatggagacaccta -continued gaagtaccagatgaatgcaaa*ggccgccgcg*caggcgcagagctagagccacatccctgctctggtcgcggctgtccgaccgtaa ctaccaccgctttagcaccccggggagggtccggagtctga Orexin Human (nucleic acid sequence):

(SEQ ID NO: 272)

Atgaaccttccttccacaaaggtctcctgggccgccgtgacgctactgctgctgctgctgctgccgcccgcgctgttgtcgtccgg ggcggctgcacagcccctgcccgactgctgtcgtcaaaagacttgctcttgccgcctctacgagctgctgcacggcgcgggcaatcac gcggccggcatcctcacgctgggcaagcggaggtccgggcccccgggcctccagggtcggctgcagcgcctcctgcaggccagc ggcaaccacgccgcgggcatcctgaccatg*ggccgccgc*Tactgcgccactgttcattgccaggactgtccttacgaacctgatcc accaaacacagttccaacttcctgtgaagctaaagaaggagaatgtattgatagcagctgtggcacctgcacgagagacatacta tcagatggactgtgtgaaaataaaccaggaaaaacatgttgccgaatgtgtcagtatgtaattgaatgcagagtagaggccgcag gatggtttagaacattctatggaaagagattccagttccaggaacctggtacatacgtgtttgggtcaaggaaccaagggcggcgac tggaaggtgtccatcaccctggagaacctggatggaaccaaggggctgtgctgaccaagacaagactggaagtggctggaga catcattgacatcgctcaagctactgagaatcccatcactgtaaacggtggagctgaccctatcatcgccaacccgtacaccatcgg cgaggtcaccatcgctgttgttgagatgccaggcttcaacatcaccgtcattgagttcttcaaactgatcgtgatcgacatcctcggag gaagatctgtaagaatcgccccagacacagcaaacaaaggaatgatctctggcctctgtggagatcttaaaatgatggaagatac agacttcacttcagatccagaacaactcgctattcagcctaagatcaaccaggagtttgacggttgtccactctatggaaatcctgat gacgttgcatactgcaaaggtcttctggagccgtacaaggacagctgccgcaacccatcaacttctactactacaccatctcctgc gccttcgcccgctgtatgggtggagacgagcgagcctcacacgtgctgcttgactacaggagacgtgcgctgctcccgaaacta gaggaacctgcgttttgtctggacatactttctacgatacatttgacaaagcaagataccaattccagggtccctgcaaggagattctt atggccgcgcgactgtttctgaacacttgggatgtgaaggtttcacacaggaatgttgactcttacactgaagtagagaaagtacga atcaggaaacaatcgactgtagtagaactcattgttgatggaaaacagattctggttggaggagaagccgtgtccgtcccgtacag ctctcagaacacttccatctactggcaagatggtgacatactgactacagccatcctacctgaagctctggtggtcaagttcaacttca agcaactgctcgtcgtacatattagagatccattcgatggtaagacttgcggtatttgcggtaactacaaccaggatttcagtgatgat tcttttgatgctgaaggagcctgtgatctgaccccaccccaccgggatgcaccgaagaacagaaacctgaagctgaacgactct gcaatagtctcttcgccggtcaaagtgatcttgatcagaaatgtaacgtgtgccacaagcctgaccgtgtcgaacgatgcatgtacg agtattgcctgaggggacaacagggttctgtgaccacgcatgggagttcaagaaagaatgctacataaagcatggagacaccct agaagtaccagatgaatgcaaa*ggccgccgcg*caggcgcagagccagcgccgcgcccctgcctcgggcgccgctgttccgccc cggccgccgcctccgtcgcgcccggaggacagtccgggatctga Ghrelin-Obestatin Mouse (nucleic acid sequence):

(SEQ ID NO: 273)

Atgctgtcttcaggcaccatctgcagtttgctgctactcagcatgctctggatggacatggccatggcaggctccagcttcctgagccca gagcaccagaaagcccagcagagaaaggaatccaagaagccaccagctaaactgcag*ccacgagct*Tactgcgccactgttcattg ccaggactgtccttacgaacctgatccaccaaacacagttccaacttcctgtgaagctaaagaaggagaatgtattgatagcagct gtggcacctgcacgagagacatactatcagatggactgtgtgaaaataaaccaggaaaaacatgttgccgaatgtgtcagtatgt aattgaatgcagagtagaggccgcaggatggtttagaacattctatggaaagagattccagttccaggaacctggtacatacgtgtt gggtcaaggaaccaagggcggcgactggaaggtgtccatcaccctggagaacctggatggaaccaaggggctgtgctgacc aagacaagactggaagtggctggagacatcattgacatcgctcaagctactgagaatcccatcactgtaaacggtggagctgacc ctatcatcgccaacccgtacaccatcggcgaggtcaccatcgctgttgttgagatgccaggcttcaacatcaccgtcattgagttcttc aaactgatcgtgatcgacatcctcggaggaagatctgtaagaatcgccccagacacagcaaacaaaggaatgatctctggcctct gtggagatcttaaaatgatggaagatacagacttcacttcagatccagaacaactcgctattcagcctaagatcaaccaggagtttg acggttgtccactctatggaaatcctgatgacgttgcatactgcaaaggtcttctggagccgtacaaggacagctgccgcaacccca tcaacttctactactacaccatctcctgcgccttcgcccgctgtatgggtggagacgagcgagcctcacacgtgctgcttgactacag

```
ggagacgtgcgctgctcccgaaactagaggaacctgcgttttgtctggacatactttctacgatacatttgacaaagcaagatacca
attccagggtccctgcaaggagattcttatggccgccgactgtttctggaacacttgggatgtgaaggtttcacacaggaatgttgact
cttacactgaagtagagaagtacgaatcaggaaacaatcgactgtagtagaactcattgttgatggaaaacagattctggttgga
ggagaagccgtgtccgtcccgtacagctctcagaacacttccatctactggcaagatggtgacatactgactacagccatcctacct
gaagctctggtggtcaagttcaacttcaagcaactgctcgtcgtacatattagagatccattcgatggtaagacttgcggtatttgcgg
taactacaaccaggatttcagtgatgattcttttgatgctgaaggagcctgtgatctgaccccaacccaccggatgcaccgaaga
acagaaacctgaagctgaacgactctgcaatagtctcttcgccggtcaaagtgatcttgatcagaaatgtaacgtgtgccacaagc
ctgaccgtgtcgaacgatgcatgtacgagtattgcctgaggggacaacagggtttctgtgaccacgcatgggagttcaagaaaga
atgctacataaagcatggagacaccctagaagtaccagatgaatgcaaaccacgagctctggaaggctggctccacccagagga
cagaggacaagcagaagagacagaggaggagctggagatcaggttcaatgctcccttcgatgttggcatcaagctgtcaggagctca
gtatcagcagcatggccgggccctggggaagtttcttcaggatatcctctgggaagaggtcaaagaggcgccagctgacaagtaa
Ghrelin-Obestatin Human (nucleic acid sequence):
                                                                                  (SEQ ID NO: 274)
Atgccctccccagggaccgtctgcagcctcctgctcctcggcatgctctggctggacttggccatggcaggctccagcttcctgagcc
ctgaacaccagagagtccagagaaaggagtcgaagaagccaccagccaagctgcagccccgagctTactgcgccactgttcattgc
caggactgtccttacgaacctgatccaccaaacacagttccaacttcctgtgaagctaaagaaggagaatgtattgatagcagctgt
ggcacctgacgagagacatactatcagatggactgtgtgaaaataaaccaggaaaaacatgttgccgaatgtgtcagtatgtaa
ttgaatgcagagtagaggccgcaggatggtttagaacattctatggaaagagattccagttccaggaacctggtacatacgtgttgg
gtcaaggaaccaagggcggcgactggaaggtgtccatcaccctggagaacctggatggaaccaagggggctgtgctgaccaa
gacaagactggaagtggctggagacatcattgacatcgctcaagctactgagaatcccatcactgtaaacggtggagctgaccct
atcatcgccaacccgtacaccatcggcgaggtcaccatcgctgttgttgagatgccaggcttcaacatcaccgtcattgagttcttca
aactgatcgtgatcgacatcctcggaggaagatctgtaagaatcgcccccagacacagcaaacaaaggaatgatctctggcctctg
tggagatcttaaaatgatggaagatacagacttcacttcagatccagaacaactcgctattcagcctaagatcaaccaggagtttga
cggttgtccactctatggaaatcctgatgacgttgcatactgcaaaggtcttctggagccgtacaaggacagctgccgcaacccat
caacttctactactacaccatctcctgcgccttcgcccgctgtatgggtggagacgagcgagcctcacacgtgctgcttgactacagg
gagacgtgcgctgctcccgaaactagaggaacctgcgttttgtctggacatactttctacgatacatttgacaaagcaagataccaa
ttccagggtccctgcaaggagattcttatggccgccgactgtttctggaacacttgggatgtgaaggtttcacacaggaatgttgactc
ttacactgaagtagagaaagtacgaatcaggaaacaatcgactgtagtagaactcattgttgatggaaaacagattctggttggag
gagaagccgtgtccgtcccgtacagctctcagaacacttccatctactggcaagatggtgacatactgactacagccatcctacctg
aagctctggtggtcaagttcaacttcaagcaactgctcgtcgtacatattagagatccattcgatggtaagacttgcggtatttgcggt
aactacaaccaggatttcagtgatgattcttttgatgctgaaggagcctgtgatctgaccccaacccaccggatgcaccgaaga
acagaaacctgaagctgaacgactctgcaatagtctcttcgccggtcaaagtgatcttgatcagaaatgtaacgtgtgccacaagc
ctgaccgtgtcgaacgatgcatgtacgagtattgcctgaggggacaacagggtttctgtgaccacgcatgggagttcaagaaaga
atgctacataaagcatggagacaccctagaagtaccagatgaatgcaaaccccgagctctagcaggctggctccgcccggaagat
ggaggtcaagcagaaggggcagaggatgaactggaagtccggttcaacgccccctttgatgttggaatcaagctgtcaggggttcagt
accagcagcacagccaggccctggggaagtttcttcaggacatcctctgggaagaggccaaagaggcccagccgacaagtga
Cholecystokinin Mouse (nucleic acid sequence):
                                                                                  (SEQ ID NO: 275)
Atgaagagcggcgtatgtctgtgcgtggtgatggcagtcctagctgctggccgccctggcgcagccggtagtccctgcagaagctacg
gacccgtggagcagcgggcgcaagaggcgccccgaaggcagctgcgggctTactgcgccactgttcattgccaggactgtcctt
acgaacctgatccaccaaacacagttccaacttcctgtgaagctaaagaaggagaatgtattgatagcagctgtggcacctgcac
gagagacatactatcagatggactgtgtgaaaataaaccaggaaaaacatgttgccgaatgtgtcagtatgtaattgaatgcaga
gtagaggccgcaggatggtttagaacattctatggaaagagattccagttccaggaacctggtacatacgtgttgggtcaaggaac
```

```
caagggcggcgactggaaggtgtccatcaccctggagaacctggatggaaccaaggggctgtgctgaccaagacaagactg gaagtggctggagacatcattgacatcgctcaagctactgagaatcccatcactgtaaacggtggagctgaccctatcatcgccaa cccgtacaccatcggcgaggtcaccatcgctgttgttgagatgccaggcttcaacatcaccgtcattgagttcttcaaactgatcgtga tcgacatcctcggaggaagatctgtaagaatcgcccagacacagcaaacaaaggaatgatctctgcctctgtggagatcttaa aatgatggaagatacagacttcacttcagatccaagaacaactcgctattcagcctaagatcaaccaggagtttgacggttgtccact ctatggaaatcctgatgacgttgcatactgcaaaggtcttctggagccgtacaaggacagctgccgcaaccccatcaacttctacta ctacaccatctcctgcgccttcgcccgctgtatgggtggagacgagcgagcctcacacgtgctgcttgactacagggagacgtgcg ctgctcccgaaactagaggaacctgcgttttgtctggacatactttctacgatacatttgacaaagcaagataccaattccagggtcc ctgcaaggagattcttatggccgccgactgtttctggaacacttgggatgtgaaggtttcacacaggaatgttgactcttacactgaa gtagagaaagtacgaatcaggaaacaatcgactgtagtagaactcattgttgatggaaaacagattctggttggaggagaagccg tgtccgtcccgtacagctctcagaacacttccatctactggcaagatggtgacatactgactacagccatcctacctgaagctctggt ggtcaagttcaacttcaagcaactgctcgtcgtacatattagagatccattcgatggtaagacttgcggtatttgcggtaactacaacc aggatttcagtgatgattcttttgatgctgaaggagcctgtgatctgaccccaaccaccggatgcaccgaagaacagaaacct gaagctgaacgactctgcaatagtctcttcgccggtcaaagtgatcttgatcagaaatgtaacgtgtgccacaagcctgaccgtgtc gaacgatgcatgtacgagtattgcctgaggggacaacagggttctgtgaccacgcatgggagttcaagaaagaatgctacataa agcatggagacaccctagaagtaccagatgaatgcaaacgaaggcagctgcgggctgtgctccggacggacggcgagcccga gcgcgcctgggcgcactgctagcgcgatacatccagcaggtccgcaaagctccttctggccgcatgtccgttcttaagaacctgcaga gcctggaccccagccatagaataagtgaccgggactacatgggctggatggattttggccggcgcagtgccgaggactacgaatacc atcgtag
```

Cholecystokinin Human (nucleic acid sequence):

(SEQ ID NO: 276)

```
atgaacagcggcgtgtgcctgtgcgtgctgatggcggtactggcggctggcgccctgacgcagccggtgcctcccgcagatcccgc gggctccgggctgcagcgggcagaggaggcgccccgtaggcagctgagggtaTactgcgccactgttcattgccaggactgtcctt acgaacctgatccaccaaacacagttccaacttcctgtgaagctaaagaaggagaatgtattgatagcagctgtggcacctgcac gagagacatactatcagatggactgtgtgaaaataaaccaggaaaaaacatgttgccgaatgtgtcagtatgtaattgaatgcaga gtagaggccgcaggatggtttagaacattctatggaaagagattccagttccaggaacctggtacatacgtgttgggtcaaggaac caagggcggcgactggaaggtgtccatcaccctggagaacctggatggaaccaaggggctgtgctgaccaagacaagactg gaagtggctggagacatcattgacatcgctcaagctactgagaatcccatcactgtaaacggtggagctgaccctatcatcgccaa cccgtacaccatcggcgaggtcaccatcgctgttgttgagatgccaggcttcaacatcaccgtcattgagttcttcaaactgatcgtga tcgacatcctcggaggaagatctgtaagaatcgcccagacacagcaaacaaaggaatgatctctgcctctgtggagatcttaa aatgatggaagatacagacttcacttcagatccagaacaactcgctattcagcctaagatcaaccaggagtttgacggttgtccact ctatggaaatcctgatgacgttgcatactgcaaaggtcttctggagccgtacaaggacagctgccgcaaccccatcaacttctacta ctacaccatctcctgcgccttcgcccgctgtatgggtggagaacgagcgagcctcacacgtgctgcttgactacagggagacgtgcg ctgctcccgaaactagaggaacctgcgttttgtctggacatactttctacgatacatttgacaaagcaagataccaattccagggtcc ctgcaaggagattcttatggccgccgactgtttctggaacacttgggatgtgaaggtttcacacaggaatgttgactcttacactgaa gtagagaaagtacgaatcaggaaacaatcgactgtagtagaactcattgttgatggaaaacagattctggttggaggagaagccg tgtccgtcccgtacagctctcagaacacttccatctactggcaagatggtgacatactgactacagccatcctacctgaagctctggt ggtcaagttcaacttcaagcaactgctcgtcgtacatattagagatccattcgatggtaagacttgcggtatttgcggtaactacaacc aggatttcagtgatgattcttttgatgctgaaggagcctgtgatctgaccccaaccaccggatgcaccgaagaacagaaacct gaagctgaacgactctgcaatagtctcttcgccggtcaaagtgatcttgatcagaaatgtaacgtgtgccacaagcctgaccgtgtc gaacgatgcatgtacgagtattgcctgaggggacaacagggttctgtgaccacgcatgggagttcaagaaagaatgctacataa
```

-continued agcatggagacaccctagaagtaccagtgaatgcaaacgtaggcagctgagggtatcgcagagaacggatggcgagtcccgag cgcacctgggcgccctgctggcaagatacatccagcaggcccggaaagctccttctggacgaatgtccatcgttaagaacctgcagaa cctggaccccagccacaggataagtgaccgggactacatgggctggatggattttggccgtcgcagtgccgaggagtatgagtaccc ctcctag Gastrin Mouse (nucleic acid sequence):

(SEQ ID NO: 277)

Atgcctcgactgtgtgtgtacatgctggtcttagtgctggctctagctaccttctcggaagcttcttggaagccccgctcccagctacagg atgcatcatctggaccagggaccaatgaggacctggaacagcgccagttcaacaagctgggctcagcctctcaccatcgaaggcagc tggggccccagggtcctcaacacttcatagcagacctgtccaagaagcagaggccacgaatggaggaagaagaagaggcctacgg atggatggactttggccgccgcagtTactgcgccactgttcattgccaggactgtccttacgaacctgatccaccaaacacagttcca acttcctgtgaagctaaagaaggagaatgtattgatagcagctgtggcacctgcacgagagacatactatcagatggactgtgtga aaataaaccaggaaaaacatgttgccgaatgtgtcagtatgtaattgaatgcagagtagaggccgcaggatggtttagaacattct atggaaagagattccagttccaggaacctggtacatacgtgttgggtcaaggaaccaagggcggcgactggaaggtgtccatca ccctggagaacctggatggaaccaaggggctgtgctgaccaagacaagactggaagtggctggagacatcattgacatcgctc aagctactgagaatcccatcactgtaaacggtggagctgaccctatcatcgccaacccgtacaccatcggcgaggtcaccatcgct gttgttgagatgccaggcttcaacatcaccgtcattgagttcttcaaactgatcgtgatcgacatcctcggaggaagatctgtaagaat cgccccagacacagcaaacaaggaatgatctctggcctctgtggagatcttaaaatgatggaagatacagacttcacttcagatc cagaacaactcgctattcagcctaagatcaaccaggagtttgacggttgtccactctatggaaatcctgatgacgttgcatactgcaa aggtcttctggagccgtacaaggacagctgccgcaacccccatcaacttctactactacaccatctcctgcgccttcgcccgctgtatg ggtggagacgagcgagcctcacacgtgctgcttgactacaggagacgtgcgctgctcccgaaactagaggaacctgcgttttgtc tggacatactttctacgatacatttgacaaagcaagataccaattccagggtccctgcaaggagattcttatggccgccgactgtttct ggaacacttgggatgtgaaggtttcacacaggaatgttgactcttacactgaagtagagaaagtacgaatcaggaaacaatcgac tgtagtagaactcattgttgatggaaaacagattctggttggaggagaagccgtgtccgtcccgtacagctctcagaacacttccatc tactggcaagatggtgacatactgactacagccatcctacctgaagctctggtggtcaagttcaacttcaagcaactgctcgtcgtac atattagagatccattcgatggtaagacttgcggtatttgcggtaactacaaccaggatttcagtgatgattcttttgatgctgaaggag cctgtgatctgaccccaacccaccgggatgcaccgaagaacagaaacctgaagctgaacgactctgcaatagtctcttcgccgg tcaaagtgatcttgatcagaaatgtaacgtgtgccacaagcctgaccgtgtcgaacgatgcatgtacgagtattgcctgaggggac aacagggtttctgtgaccacgcatgggagttcaagaaagaatgctacataaagcatggagacaccctagaagtaccagatgaat gcaaacgccgcagtgctgaggaagaccagtag Gastrin Human (nucleic acid sequence):

(SEQ ID NO: 278)

Atgcagcgactatgtgtgtatgtgctgatctttgcactggctctggccgccttctctgaagcttcttggaagccccgctcccagcagccag atgcacccttaggtacaggggccaacagggacctggagctacccggctggagcagcagggcccagcctctcatcatcgaaggcag ctgggaccccagggtcccccacacctcgtggcagacccgtccaagaagcagggaccatggctggaggaagaagaagaagcctatg gatggatggacttcggccgccgcagtTactgcgccactgttcattgccaggactgtccttacgaacctgatccaccaaacacagttc caacttcctgtgaagctaaagaaggagaatgtattgatagcagctgtggcacctgcacgagagacatactatcagatggactgtgt gaaaataaaccaggaaaaacatgttgccgaatgtgtcagtatgtaattgaatgcagagtagaggccgcaggatggtttagaacat tctatggaaagagattccagttccaggaacctggtacatacgtgttgggtcaaggaaccaagggcggcgactggaaggtgtccat caccctggagaacctggatggaaccaaggggctgtgctgaccaagacaagactggaagtggctggagacatcattgacatcg ctcaagctactgagaatcccatcactgtaaacggtggagctgaccctatcatcgccaacccgtacaccatcggcgaggtcaccatc gctgttgttgagatgccaggcttcaacatcaccgtcattgagttcttcaaactgatcgtgatcgacatcctcggaggaagatctgtaag aatcgccccagacacagcaaacaaggaatgatctctggcctctgtggagatcttaaaatgatggaagatacagacttcacttcag atccagaacaactcgctattcagcctaagatcaaccaggagtttgacggttgtccactctatggaaatcctgatgacgttgcatactg -continued caaaggtcttctggagccgtacaaggacagctgccgcaacccatcaacttctactactacaccatctcctgcgccttcgcccgctgt atgggtggagacgagcgagcctcacacgtgctgcttgactacagggagacgtgcgctgctcccgaaactagaggaacctgcgttt tgtctggacatactttctacgatacatttgacaaagcaagataccaattccagggtcctgcaaggagattcttatggccgccgactg tttctggaacacttgggatgtgaaggtttcacacaggaatgttgactcttacactgaagtagagaaagtacgaatcaggaaacaatc gactgtagtagaactcattgttgatggaaaacagattctggttggaggagaagccgtgtccgtcccgtacagctctcagaacacttc catctactggcaagatggtgacatactgactacagccatcctacctgaagctctggtggtcaagttcaacttcaagcaactgctcgtc gtacatattagagatccattcgatggtaagacttgcggtatttgcggtaactacaaccaggatttcagtgatgattcttttgatgctgaa ggagcctgtgatctgaccccaacccaccgggatgcaccgaagaacagaaacctgaagctgaacgactctgcaatagtctcttcg ccggtcaaagtgatcttgatcagaaatgtaacgtgtgccacaagcctgaccgtgtcgaacgatgcatgtacgagtattgcctgagg ggacaacagggtttctgtgaccacgcatgggagttcaagaaagaatgctacataaagcatggagacaccctagaagtaccagat gaatgcaaa*cgccgcagt*gctgaggatgagaactaa Protachykinin-1 (Substance P, Neurokinin A, Neuropeptide K, Neuropeptide gamma) Mouse
(nucleic acid sequence):

(SEQ ID NO: 279)

atgaaaatcctcgtggccgtggcggtcttttttctcgtttccactcaactgtttgcagaggaaatcgatgccaacgatgatctaaattattggt ccgactggtccgacagtgaccagatcaaggaggcaatgccggagcccttgagcatcttctgcagagaatcgcc*cgaaga*Tactgcg ccactgttcattgccaggactgtccttacgaacctgatccaccaaacacagttccaacttcctgtgaagctaaagaaggagaatgta ttgatagcagctgtggcacctgcacgagagacatactatcagatggactgtgtgaaaataaaccaggaaaaacatgttgccgaat gtgtcagtatgtaattgaatgcagagtagaggccgcaggatggtttagaacattctatggaaagagattccagttccaggaacctgg tacatacgtgttgggtcaaggaaccaagggcggcgactggaaggtgtccatcaccctggagaacctggatggaaccaaggggg ctgtgctgaccaagacaagactggaagtggctggagacatcattgacatcgctcaagctactgagaatcccatcactgtaaacggt ggagctgacctatcatcgccaacccgtacaccatcggcgaggtcaccatcgctgttgttgagatgccaggcttcaacatcaccgtc attgagttcttcaaactgatcgtgatcgacatcctcggaggaagatctgtaagaatcgcccagacacagcaaacaaaggaatga tctctgcctctgtggagatcttaaaatgatggaagatacagacttcacttcagatccagaacaactcgctattcagcctaagatcaa ccaggagtttgacggttgtccactctatggaaatcctgatgacgttgcatactgcaaaggtcttctggagccgtacaaggacagctg ccgcaaccccatcaacttctactactacaccatctcctgcgccttcgcccgctgtatgggtggagacgagcgagcctcacacgtgct gcttgactacagggagacgtgcgctgctcccgaaactagaggaacctgcgttttgtctggacatactttctacgatacatttgacaaa gcaagataccaattccagggtcctgcaaggagattcttatggccgccgactgtttctggaacacttgggatgtgaaggtttcacac aggaatgttgactcttacactgaagtagagaaagtacgaatcaggaaacaatcgactgtagtagaactcattgttgatggaaaaca gattctggttggaggagaagccgtgtccgtcccgtacagctctcagaacacttccatctactggcaagatggtgacatactgactac agccatcctacctgaagctctggtggtcaagttcaacttcaagcaactgctcgtcgtacatattagagatccattcgatggtaagactt gcggtatttgcggtaactacaaccaggatttcagtgatgattcttttgatgctgaaggagcctgtgatctgaccccaacccaccggg atgcaccgaagaacagaaacctgaagctgaacgactctgcaatagtctcttcgccggtcaaagtgatcttgatcagaaatgtaacg tgtgccacaagcctgaccgtgtcgaacgatgcatgtacgagtattgcctgaggggacaacagggtttctgtgaccacgcatgggag ttcaagaaagaatgctacataaagcatggagacaccctagaagtaccagatgaatgcaaa*cgaaga*cccaagcctcagcagttct ttggattaatgggcaagcgggatgctgattcctcagttgaaaaacaagtggccctgttaaaggctctttatggacatggccagatctctca caaaaggcataaaacagattcctttgttggactaatgggcaaagagctttaaattctgtggcttatgaaagaagcgcgatgcagaactac gaaagaagacgtaaataa Protachykinin-1 (Substance P, Neurokinin A, Neuropeptide K, Neuropeptide gamma) Human
(nucleic acid sequence):

(SEQ ID NO: 280)

atgaaaatcctcgtggccttggcagtcttttttcttgtctccactcagctgtttgcagaagaaataggagccaatgatgatctgaattactggt ccgactggtacgacagcgaccagatcaaggaggaactgccggagcccttgagcatcactgcagagaatcgcc*cggaga*Tactgc -continued

```
gccactgttcattgccaggactgtccttacgaacctgatccaccaaacacagttccaacttcctgtgaagctaaagaaggagaatgt
attgatagcagctgtggcacctgcacgagagacatactatcagatggactgtgtgaaaataaaccaggaaaaacatgttgccgaa
tgtgtcagtatgtaattgaatgcagagtagaggccgcaggatggtttagaacattctatggaaagagattccagttccaggaacctg
gtacatacgtgttgggtcaaggaaccaagggcggcgactggaaggtgtccatcaccctggagaacctggatggaaccaagggg
gctgtgctgaccaagacaagactggaagtggctggagacatcattgacatcgctcaagctactgagaatcccatcactgtaaacg
gtggagctgaccctatcatcgccaacccgtacaccatcggcgaggtcaccatcgctgttgttgagatgccaggcttcaacatcaccg
tcattgagttcttcaaactgatcgtgatcgacatcctcggaggaagatctgtaagaatcgccccagacacagcaaacaaaggaatg
atctctggcctctgtggagatcttaaaatgatggaagatacagacttcacttcagatccagaacaactcgctattcagcctaagatca
accaggagtttgacggttgtccactctatggaaatcctgatgacgttgcatactgcaaaggtcttctggagccgtacaaggacagct
gccgcaaccccatcaacttctactactacaccatctcctgcgccttcgcccgctgtatgggtggagacgagcgagcctcacacgtgc
tgcttgactacagggagacgtgcgctgctcccgaaactagaggaacctgcgtttgtctggacatactttctacgatacatttgacaa
agcaagataccaattccagggtccctgcaaggagattcttatggccgccgactgtttctggaacacttgggatgtgaaggtttcaca
caggaatgttgactcttacactgaagtagagaaagtacgaatcaggaaacaatcgactgtagtagaactcattgttgatggaaaac
agattctggttggaggagaagccgtgtccgtcccgtacagctctcagaacacttccatctactggcaagatggtgacatactgacta
cagccatcctacctgaagctctggtggtcaagttcaacttcaagcaactgctcgtcgtacatattagagatccattcgatggtaagact
tgcggtatttgcggtaactacaaccaggatttcagtgatgattcttttgatgctgaaggagcctgtgatctgaccccaacccaccgg
gatgcaccgaagaacagaaacctgaagctgaacgactctgcaatagtctcttcgccggtcaaagtgatcttgatcagaaatgtaac
gtgtgccacaagcctgaccgtgtcgaacgatgcatgtacgagtattgcctgaggggacaacagggtttctgtgaccacgcatggga
gttcaagaaagaatgctacataaagcatggagacaccctagaagtaccagatgaatgcaaacqqaqacccaagcctcagcagtt
ctttggattaatgggcaaacgggatgctgattcctcaattgaaaaacaagtggccctgttaaaggctctttatggacatggccagatctctc
acaaaagacataaaacagattcctttgttggactaatgggcaaaagagctttaaattctgtggcttatgaaaggagtgcaatgcagaattat
gaaagaagacgttaa
```

Proenkephalin-A Mouse (nucleic acid sequence):
(SEQ ID NO: 281)

```
atggcgcggttcctgaggctttgcacctggctgctggcgcttgggtcctgcctcctggctacagtgcaggcggaatgcagccaggact
gcgctaaatgcagctaccgcctggttcgcccaggcgacatcaatttcctggcgtgcacactggaatgtgaaggacagctgccttctttca
aaatctgggagacctgcaaggatctcctgcaggtgtccaggcccgagttcccttgggataacatcgacatgtacaaagacagcagcaa
acaggatgagagccacttgctagccaagaagtacggaggcttcatgaaacggtacgaggcttcatgaagaagatggacgagctatat
cccatggagccagaagaagaagcgaacggaggagagatccttgccaagaggtatggcggcttcatgaagaaggatgcagatgagg
gagacaccttggccaactcctccgatctgctgaaagagctactgggaacgggagacaacgtgcgaaagacagccaccaacaagag
agcaccaacaatgacgaagacatgagcaagaggtatgggggcttcatgagaagcctcaaaagaagcccccaactggaagatgaagc
aaaagagctgcagaagcgctacggggcttcatgagaaggTactgcgccactgttcattgccaggactgtccttacgaacctgatcc
accaaacacagttccaacttcctgtgaagctaaagaaggagaatgtattgatagcagctgtggcacctgcacgagagacatacta
tcagatggactgtgtgaaaataaaccaggaaaaacatgttgccgaatgtgtcagtatgtaattgaatgcagagtagaggccgcag
gatggtttagaacattctatggaaagagattccagttccaggaacctggtacatacgtgttgggtcaaggaaccaagggcggcgac
tggaaggtgtccatcaccctggagaacctggatggaaccaagggggctgtgctgaccaagacaagactggaagtggctggaga
catcattgacatcgctcaagctactgagaatcccatcactgtaaacggtggagctgaccctatcatcgccaacccgtacaccatcgg
cgaggtcaccatcgctgttgttgagatgccaggcttcaacatcaccgtcattgagttcttcaaactgatcgtgatcgacatcctcggag
gaagatctgtaagaatcgccccagacacagcaaacaaaggaatgatctctggcctctgtggagatcttaaaatgatggaagatac
agacttcacttcagatccagaacaactcgctattcagcctaagatcaaccaggagtttgacggttgtccactctatggaaatcctgat
gacgttgcatactgcaaaggtcttctggagccgtacaaggacagctgccgcaaccccatcaacttctactactacaccatctcctgc
gccttcgcccgctgtatgggtggagacgagcgagcctcacacgtgctgcttgactacagggagacgtgcgctgctcccgaaacta
``` gaggaacctgcgttttgtctggacatactttctacgatacatttgacaaagcaagataccaattccagggtcctgcaaggagattctt
atggccgccgactgtttctggaacacttgggatgtgaaggttttcacacaggaatgttgactcttacactgaagtagagaaagtacga
atcaggaaacaatcgactgtagtagaactcattgttgatggaaaacagattctggttggaggagaagccgtgtccgtcccgtacag
ctctcagaacacttccatctactggcaagatggtgacatactgactacagccatcctacctgaagctctggtggtcaagttcaacttca
agcaactgctcgtcgtacatattagagatccattcgatggtaagacttgcggtatttgcggtaactacaaccaggatttcagtgatgat
tcttttgatgctgaaggagcctgtgatctgaccccccaacccaccgggatgcaccgaagaacagaaacctgaagctgaacgactct
gcaatagtctcttcgccggtcaaagtgatcttgatcagaaatgtaacgtgtgccacaagcctgaccgtgtcgaacgatgcatgtacg
agtattgcctgaggggacaacaggggttctgtgaccacgcatgggagttcaagaaagaatgctcataaagcatggagacaccct
agaagtaccagatgaatgcaaa<u>agaagg</u>gtgggacgccccgagtggtggatggactaccagaagaggtatgggggcttcctgaa
gcgctttgctgagtctctgccctccgatgaagaaggcgaaaattactcgaaagaagttcctgagatagagaaagatacgggggctttat
gcggttctga Proenkephalin-A Human (nucleic acid sequence):

(SEQ ID NO: 282)

atggcgcggttcctgacactttgcacttggctgctgttgctcggccccgggctcctggcgaccgtgcgggccgaatgcagccaggattg
cgcgacgtgcagctaccgcctagtgcgcccggccgacatcaacttcctggcttgcgtaatggaatgtgaaggtaaactgccttctctga
aaatttgggaaacctgcaaggagctcctgcagctgtccaaaccagagcttcctcaagatggcaccagcaccctcagagaaaatagcaa
accggaagaaagccatttgctagccaaaaggtatgggggcttcatgaaaaggtatggaggcttcatgaagaaaatggatgagctttatc
ccatggagccagaagaagaggccaatggaagtgagatcctcgccaagcggtatgggggcttcatgaagaaggatgcagaggagga
cgactcgctggccaattcctcagacctgctaaaagagcttctggaaacaggggacaaccgagagcgtagccaccaccaggatggca
gtgataatgaggaagaagtgagcaagagatatggggggcttcatgagaggcttaaagagaagcccccaactgaagatgaagccaaa
gagctgcagaagcgatatgggggcttcatg<u>agaaga</u>Tactgcgccactgttcattgccaggactgtccttacgaacctgatccacca
aacacagttccaacttcctgtgaagctaaagaaggagaatgtattgatagcagctgtggcacctgcacgagagacatactatcag
atggactgtgtgaaaataaaccaggaaaaacatgttgccgaatgtgtcagtatgtaattgaatgcagagtagaggccgcaggatg
gtttagaacattctatggaaagagattccagttccaggaacctggtacatacgtgttgggtcaaggaaccaagggcggcgactgga
aggtgtccatcaccctggagaacctggatggaaccaagggggctgtgctgaccaagacaagactggaagtggctggagacatc
attgacatcgctcaagctactgagaatcccatcactgtaaacggtggagctgacccatcatcgccaacccgtacaccatcggcga
ggtcaccatcgctgttgttgagatgccaggcttcaacatcaccgtcattgagttcttcaaactgatcgtgatcgacatcctcggaggaa
gatctgtaagaatcgcccagacacagcaaacaaggaatgatctctggcctctgtggagatcttaaaatgatggaagatacaga
cttacttcagatccagaacaactcgctattcagcctaagatcaaccaggagtttgacggttgtccactctatggaaatcctgatgac
gttgcatactgcaaaggtcttctggagccgtacaaggacagctgccgcaaccccatcaacttctactactacaccatctcctgcgcct
tcgcccgctgtatgggtggagacgagcagcctcacgcgtgctgcttgactacagggagacgtgcgctgctcccgaaactagagg
aacctgcgttttgtctggacatactttctacgatacatttgacaaagcaagataccaattccagggtcctgcaaggagattcttatgg
ccgccgactgtttctggaacacttgggatgtgaaggtttcacacaggaatgttgactcttacactgaagtagagaaagtacgaatca
ggaacaatcgactgtagtagaactacattgttgatggaaaacagattctggttggaggagaagccgtgtccgtcccgtacagctctc
agaacacttccatctactggcaagatggtgacatactgactacagccatcctacctgaagctctggtggtcaagttcaacttcaagc
aactgctcgtcgtacatattagagatccattcgatggtaagacttgcggtatttgcggtaactacaaccaggatttcagtgatgattctt
tgatgctgaaggagcctgtgatctgaccccccaacccaccgggatgcaccgaagaacagaaacctgaagctgaacgactctgcaa
tagtctcttcgccgttcaaagtgatcttgatcagaaatgtaacgtgtgccacaagcctgaccgtgtcgaacgtgcatgtacgagtat
tgcctgaggggacaacaggggttctgtgaccacgcatgggagttcaagaaagaatgctcataaagcatggagacaccctagaa
gtaccagatgaatgcaaa<u>agaagag</u>taggtcgcccagagtggtggatggactaccagaaacggtatggaggtttcctgaagcgcttt -continued gccgaggctctgccctccgacgaagaaggcgaaagttactccaaagaagttcctgaaatggaaaaaagatacggaggatttatgagat tttaa Proenkephalin-B Mouse (nucleic acid sequence):
(SEQ ID NO: 283)

atggcgtggtccaggctgatgctggcagcttgcctcctcgtgatgccctctaatgttatggcggactgcctgtccctgtgctccctgtgt gcagtgaggattcaggatgggccccgtcccatcaaccccctgatttgctccctggagtgccaggacctggtgccgccctcagagga gtgggagacatgccggggcttctcatcttttctcaccctgacggtctctgggctccgtggcaaggatgacttggaagatgaggttgctt tggaagaaggctacagtgcactagccaagctcttggaacccgtcctgaaggagctggagaaaagccgactccttaccagcgtcc cagaggaaaagttcaggggtctctccagcagctttggcaacggaaaagaatctgagctggcgggtgctgaccggatgaatgatg aagccgcacaggcgggcacgctccattttaatgaggaggacttgagaaaacaggccaaacgctatggcggcttttttgcgcaaata cccc<u>aagagg</u>Tactgcgccactgttcattgccaggactgtccttacgaacctgatccaccaaacacagttccaacttcctgtgaagc taaagaaggagaatgtattgatagcagctgtggcacctgcacgagagacatactatcagatggactgtgtgaaaataaaccagg aaaaacatgttgccgaatgtgtcagtatgtaattgaatgcagagtagaggccgcaggatggtttagaacattctatggaaagagatt ccagttccaggaacctggtacatacgtgtgggtcaaggaaccaagggcggcgactggaaggtgtccatcaccctggagaacct ggatggaaccaaggggctgtgctgaccaagacaagactggaagtggctggagacatcattgacatcgctcaagctactgaga atcccatcactgtaaacggtggagctgaccctatcatcgccaacccgtacaccatcggcgaggtcaccatcgctgttgttgagatgc caggcttcaacatcaccgtcattgagttcttcaaactgatcgtgatcgacatcctcggaggaagatctgtaagaatcgcccagaca cagcaaacaaggaatgatctctggcctctgtggagatcttaaaatgatggaagatacagacttcacttcagatccagaacaactc gctattcagcctaagatcaaccaggagtttgacggttgtccactctatggaaatcctgatgacgttgcatactgcaaaggtcttctgga gccgtacaaggacagctgccgcaacccccatcaacttctactactacaccatctcctgcgccttcgcccgctgtatgggtggagacga gcgagcctcacacgtgctgcttgactacagggagacgtgcgctgctcccgaaactagaggaacctgcgttttgtctggacatactttc tacgatacatttgacaaagcaagataccaattccagggtccctgcaaggagattcttatggccgccgactgtttctggaacacttgg gatgtgaaggttttcacacaggaatgttgactcttacactgaagtagagaaagtacgaatcaggaaacaatcgactgtagtagaact cattgttgatgaaaacagattctggttggaggagaagccgtgtccgtcccgtacagctctcagaacacttccatctactggcaaga tggtgacatactgactacagccatcctacctgaagctctggtggtcaagttcaacttcaagcaactgctcgtcgtacatattagagatc cattcgatggtaagacttgcgctatttgcggtaactacaaccaggatttcagtgatgattcttttgatgctgaaggagcctgtgatctga cccccaacccaccgggatgcaccgaagaacagaaacctgaagctgaacgactctgcaatagtctcttcgccggtcaaagtgatct tgatcagaaatgtaaacgtgtgccacaagcctgaccgtgtcgaacgatgcatgtacgagtattgcctgagggacaacagggttct gtgaccacgcatgggagttcaagaaagaatgctacataaagcatggagacaccctagaagtaccagatgaatgcaaa<u>aagagg</u> agttccgagatggcccgggatgaggacgggggccaggatgggatcaggtagggcatgaggacctgtacaaacgctatgggggctt cctgcggcgcattcgccccaagctgaagtgggacaaccagaagcgctatggtggtttcctgcggcgtcagttcaaggtggtgacgcg gtcccaggagaaccccaataccctattctgaagatttagatgtttga Proenkephalin-B Human (nucleic acid sequence):
(SEQ ID NO: 284)

atggcctggcagggctggtcctggctgcctgcctcctcatgttcccctccaccacagcggactgcctgtcgcggtgctccttgtgtgct gtaaagacccaggatggtcccaaacctatcaatccctgatttgctccctgcaatgccaggctgccctgctgccctctgaggaatggga gagatgccagagctttctgtctttttttcaccccctccacccttgggctcaatgacaaggaggacttggggagcaagtcggttggggaagg gccctacagtgagctggccaagctctctgggtcattcctgaaggagctggagaaaagcaagtttctcccaagtatctcaacaaaggaga acactctgagcaagagcctggaggagaagctcaggggtctctctgacgggtttaggagggagcagagtctgagctgatgagggatg cccagctgaacgatggtgccatggagactggcacactctatctcgctgaggaggaccccaaggagcaggtc<u>aaacgc</u>Tactgcgcc actgttcattgccaggactgtccttacgaacctgatccaccaaacacagttccaacttcctgtgaagctaaagaaggagaatgtattg atagcagctgtggcacctgcacgagagacatactatcagatggactgtgtgaaaataaaccaggaaaaacatgttgccgaatgtg -continued

```
tcagtatgtaattgaatgcagagtagaggccgcaggatggtttagaacattctatggaaagagattccagttccaggaacctggtac atacgtgttgggtcaaggaaccaagggcggcgactggaaggtgtccatcaccctggagaacctggatggaaccaaggggctgt gctgaccaagacaagactggaagtggctggagacatcattgacatcgctcaagctactgagaatcccatcactgtaaacggtgga gctgaccctatcatcgccaacccgtacaccatcggcgaggtcaccatcgctgttgttgagatgccaggcttcaacatcaccgtcattg agttcttcaaactgatcgtgatcgacatcctcggaggaagatctgtaagaatcgcccagacacagcaaacaaaggaatgatctct ggcctctgtggagatcttaaaatgatggaagtacagacttcacttcagatccagaacaactcgctattcagcctaagatcaaccag gagtttgacggttgtccactctatggaaatcctgatgacgttgcatactgcaaaggtcttctggagccgtacaaggacagctgccgc aaccccatcaacttctactactacaccatctcctgcgccttcgcccgctgtatgggtgggagacgagcagcctcacacgtgctgcttg actacagggagacgtgcgctgctcccgaaactagaggaacctgcgttttgtctggacatactttctacgatacatttgacaaagcaa gataccaattccagggtccctgcaaggagattcttatggccgccgactgtttctggaacacttgggatgtgaaggtttcacacagga atgttgactcttacactgaagtagagaaagtacgaatcaggaaacaatcgactgtagtagaactcattgttgatggaaaacagattc tggttggaggagaagccgtgtccgtcccgtacagctctcagaacacttccatctactggcaagatggtgacatactgactacagcca tcctacctgaagctctggtggtcaagttcaacttcaagcaactgctcgtcgtacatattagagatccattcgatggtaagacttgcggt atttgcggtaactacaaccaggatttcagtgatgattcttttgatgctgaaggagcctgtgatctgaccccaacccaccgggatgca ccgaagaacagaaacctgaagctaacgactctgcaatagtctcttcgccggtcaaagtgatcttgatcagaaatgtaacgtgtgc cacaagcctgaccgtgtcgaacgatgcatgtacgagtattgcctgaggggacaacagggtttctgtgaccacgcatgggagttcaa gaaagaatgctacataaagcatggagacaccctagaagtaccagatgaatgcaaaaaacgctatgggggcttttttgcgcaaatac cccaagaggagctcagaggtggctggggaggggacggggatagcatgggccatgaggacctgtacaaacgctatgggggcttctt gcggcgcattcgtcccaagctcaagtgggacaaccagaagcgctatggcggttttctccggcgccagttcaaggtggtgactcggtctc aggaagatccgaatgcttactctggagagcttttttgatgcataa
```

Insulin-like growth hormone 1 (IGF-1) Mouse (nucleic acid sequence):

(SEQ ID NO: 285)

```
atggggaaaatcagcagccttccaactcaattatttaagatctgcctctgtgacttcttgaagatataagatacacatcatgtcgtcttcacac ctcttctacctggcgctctgcttgctcaccttcaccagctccaccacagctggaccagagacccctttgcggggctgagctggtggatgct cttcagttcgtgtgtggaccgaggggcttttacttcaacaagcccacaggctatggctccagcattcggaggTactgcgccactgttcat tgccaggactgtccttacgaacctgatccaccaaacacagttccaacttcctgtgaagctaaagaaggagaatgtattgatagcag ctgtggcacctgcacgagagacatactatcagatggactgtgtgaaaataaaccaggaaaaacatgttgccgaatgtgtcagtatg taattgaatgcagagtagaggccgcaggatggtttagaacattctatggaaagagattccagttccaggaacctggtacatacgtgt tgggtcaaggaaccaagggcggcgactggaaggtgtccatcaccctggagaacctggatggaaccaaggggctgtgctgacc aagacaagactggaagtggctggagacatcattgacatcgctcaagctactgagaatcccatcactgtaaacggtggagctgacc ctatcatcgccaacccgtacaccatcggcgaggtcaccatcgctgttgttgagatgccaggcttcaacatcaccgtcattgagttcttc aaactgatcgtgatcgacatcctcggaggaagatctgtaagaatcgcccagacacagcaaacaaaggaatgatctctggcctct gtggagatcttaaaatgatggaagatacagacttcacttcagatccagaacaactcgctattcagcctaagatcaaccaggagtttg acggttgtccactctatggaaatcctgatgacgttgcatactgcaaaggtcttctggagccgtacaaggacagctgccgcaaccccca tcaacttctactactacaccatctcctgcgccttcgcccgctgtatgggtgggagacgagcagcctcacacgtgctgcttgactacag ggagacgtgcgctgctcccgaaactagaggaacctgcgttttgtctggacatactttctacgatacatttgacaaagcaagatacca attccagggtccctgcaaggagattcttatggccgccgactgtttctggaacacttgggatgtgaaggtttcacacaggaatgttgact cttacactgaagtagagaaagtacgaatcaggaaacaatcgactgtagtagaactcattgttgatggaaaacagattctggttgga ggagaagccgtgtccgtcccgtacagctctcagaacacttccatctactggcaagatggtgacatactgactacagccatcctacct gaagctctggtggtcaagttcaacttcaagcaactgctcgtcgtacatattagagatccattcgatggtaagacttgcggtatttgcgg taactacaaccaggatttcagtgatgattcttttgatgctgaaggagcctgtgatctgaccccaacccaccgggatgcaccgaaga acagaaacctgaagctaacgactctgcaatagtctcttcgccggtcaaagtgatcttgatcagaaatgtaacgtgtgccacaagc
```

-continued ctgaccgtgtcgaacgatgcatgtacgagtattgcctgaggggacaacagggtttctgtgaccacgcatgggagttcaagaaaga atgctacataaagcatggagacaccctagaagtaccagatgaatgcaaa*tccagcattcggagg*gcacctcagacaggcattgtg gatgagtgttgcttccggagctgtgatctgaggagactggagatgtactgtgccccactgaagcctacaaaagcagcccgctctatccgt gcccagcgccacactgacatgcccaagactcagaagtccccgtccctatcgacaaacaagaaaacgaagctgcaaaggagaaggaa aggaagtacatttgaagaacacaagtag Insulin-like growth hormone 1 (IGF-1) Human (nucleic acid sequence):

(SEQ ID NO: 286)

atgggaaaaatcagcagtcttccaacccaattatttaagtgctgcttttgtgatttcttgaaggtgaagatgcacaccatgtcctcctcgcatc tcttctacctggcgctgtgcctgctcaccttcaccagctctgccacggctggaccggagacgctctgcggggctgagctggtggatgct cttcagttcgtgtgtggagacaggggcttttatttcaacaagcccacagggtatggctcc*agcagtcggagg*Tactgcgccactgttcat tgccaggactgtccttacgaacctgatccaccaaacacagttccaacttcctgtgaagctaaagaaggagaatgtattgatagcag ctgtggcacctgcacgagagacatactatcagatggactgtgtgaaaataaaccaggaaaaacatgttgccgaatgtgtcagtatg taattgaatgcagagtagaggccgcaggatggtttagaacattctatggaaagagattccagttccaggaacctggtacatacgtgt tgggtcaaggaaccaagggcggcgactggaaggtgtccatcaccctggagaacctggatggaaccaagggggctgtgctgacc aagacaagactggaagtggctggagacatcattgacatcgctcaagctactgagaatcccatcactgtaaacggtggagctgacc ctatcatcgccaacccgtacaccatcggcgaggtcaccatcgctgttgttgagatgccaggcttcaacatcaccgtcattgagttcttc aaactgatcgtgatcgacatcctcggaggaagatctgtaagaatcgccccagacacagcaaacaaaggaatgatctctggcctct gtggagatcttaaaatgatggaagatacagacttcacttcagatccagaacaactcgctattcagcctaagatcaaccaggagtttg acggttgtccactctatggaaatcctgatgacgttgcatactgcaaaggtcttctggagccgtacaaggacagctgccgcaaccca tcaacttctactactacaccatctcctgcgccttcgcccgctgtatgggtggagacgagcgagcctcacacgtgctgcttgactacag ggagacgtgcgctgctcccgaaactagaggaacctgcgttttgtctggacatactttctacgatacatttgacaaagcaagatacca attccagggtccctgcaaggagattcttatggccgccgactgtttctggaacacttgggatgtgaaggtttcacacaggaatgttgact cttacactgaagtagagaaagtacgaatcaggaaacaatcgactgtagtagaactcattgttgatgaaaacagattctggttgga ggagaagccgtgtccgtcccgtacagctctcagaacacttccatctactggcaagatggtgacatactgactacagccatcctacct gaagctctggtggtcaagttcaacttcaagcaactgctcgtcgtacatattagagatccattcgatggtaagacttgcggtatttgcgg taactacaaccaggatttcagtgatgattcttttgatgctgaaggagcctgtgatctgaccccaacccaccgggatgcaccgaaga acagaaacctgaagctgaacgactctgcaatagtctcttcgccggtcaaagtgatcttgatcagaaatgtaacgtgtgccacaagc ctgaccgtgtcgaacgatgcatgtacgagtattgcctgaggggacaacagggtttctgtgaccacgcatgggagttcaagaaaga atgctacataaagcatggagacaccctagaagtaccagatgaatgcaaa*agcagtcggagg*gcgcctcagacaggcatcgtgga tgagtgctgcttccggagctgtgatctaaggaggctggagatgtattgcgcaccccctcaagcctgccaagtcagctcgctctgtccgtgc ccagcgccacaccgacatgcccaagacccagaagtatcagcccccatctaccaacaagaacacgaagtctcagagaaggaaagga agtacatttgaagaacgcaagtag Insulin-like growth hormone 2 (IGF-2)Mouse (nucleic acid sequence):

(SEQ ID NO: 287)

atgggcggcagcgtcgccggcttccaggtaccaatgggatcccagtggggaagtcgatgttggtgcttctcatctctttggccttcgcc ttgtgctgcatcgctgcttacggccccggagagactctgtgcggaggggagcttgagacacgcttcagtagtctgacggaccgcggc ttctacttcagcaggccttcaagccgtgccaaccgtcgcagccgtggcatcgtggaagagtgctgcttccgcagctgcgacctggccct cctggagacatactgtgccacccccgccaagtc*gagagggac*Tactgcgccactgttcattgccaggactgtccttacgaacctga tccaccaaacacagttccaacttcctgtgaagctaaagaaggagaatgtattgatagcagctgtggcacctgcacgagagacata ctatcagatggactgtgtgaaaataaaccaggaaaaacatgttgccgaatgtgtcagtatgtaattgaatgcagagtagaggccgc aggatggtttagaacattctatggaaagagattccagttccaggaacctggtacatacgtgttgggtcaaggaaccaagggcggc gactggaaggtgtccatcaccctggagaacctggatggaaccaagggggctgtgctgaccaagacaagactggaagtggctgg -continued agacatcattgacatcgctcaagctactgagaatcccatcactgtaaacggtggagctgaccctatcatcgccaacccgtacaccat cggcgaggtcaccatcgctgttgttgagatgccaggcttcaacatcaccgtcattgagttcttcaaactgatcgtgatcgacatcctcg gaggaagatctgtaagaatcgccccagacacagcaaacaaaggaatgatctctggcctctgtggagatcttaaaatgatggaag atacagacttcacttcagatccagaacaactcgctattcagcctaagatcaaccaggagtttgacggttgtccactctatggaaatcc tgatgacgttgcatactgcaaaggtcttctggagccgtacaaggacagctgccgcaacccatcaacttctactactacaccatctcc tgcgccttcgcccgctgtatgggtggagacgagcgagcctcacacgtgctgcttgactacagggagacgtgcgctgctcccgaaac tagaggaacctgcgttttgtctggacatactttctacgatacatttgacaaagcaagataccaattccagggtcctgcaaggagatt cttatggccgccgactgtttctggaacacttgggatgtgaaggtttcacacaggaatgttgactcttacactgaagtagagaaagtac gaatcaggaaacaatcgactgtagtagaactcattgttgatggaaaacagattctggttggaggagaagccgtgtccgtcccgtac agctctcagaacacttccatctactggcaagatggtgacatactgactacagccatcctacctgaagctctggtggtcaagttcaact tcaagcaactgctcgtcgtacatattagagatccattcgatggtaagacttgcggtatttgcggtaactacaaccaggatttcagtgat gattcttttgatgctgaaggagcctgtgatctgacccccaacccaccgggatgcaccgaagaacagaaacctgaagctgaacgac tctgcaatagtctcttcgccggtcaaagtgatcttgatcagaaatgtaacgtgtgccacaagcctgaccgtgtcgaacgatgcatgta cgagtattgcctgagggacaacagggtttctgtgaccacgcatgggagttcaagaaagaatgctacataaagcatggagacac cctagaagtaccagatgaatgcaaa<u>gagagggac</u>gtgtctacctctcaggccgtacttccggacgacttccccagataccccgtggg caagttcttccaatatgacacctggagacagtccgcgggacgcctgcgcagaggcctgcctgccctcctgcgtgcccgcggggtcg catgcttgccaaagagctcaaagagttcagagaggccaaacgtcatcgtccctgatcgtgttaccacccaaagaccccgcccacggg ggagcctcttcggagatgtccagcaaccatcagtga Insulin-like growth hormone 2 (IGF-2) Human (nucleic acid sequence):

(SEQ ID NO: 288)

atgggaatcccaatggggaagtcgatgctggtgcttctcaccttcttggccttcgcctcgtgctgcattgctgcttaccgccccagtgag accctgtgcggcggggagctggtggacaccctccagttcgtctgtggggaccgcggcttctacttcagcaggcccgcaagccgtgt gagccgtcgcagccgtggcatcgttgaggagtgctgtttccgcagctgtgacctggccctcctggagacgtactgtgctaccccgc caagtcc<u>gagagggac</u>Tactgcgccactgttcattgccaggactgtccttacgaacctgatccaccaaacacagttccaacttcctg tgaagctaaagaaggagaatgtattgatagcagctgtggcacctgcacgagagacatactatcagatggactgtgtgaaaataaa ccaggaaaaacatgttgccgaatgtgtcagtatgtaattgaatgcagagtagaggccgcaggatggtttagaacattctatggaaa gagattccagttccaggaacctggtacatacgtgttgggtcaaggaaccaagggcggcgactggaaggtgtccatcaccctggag aacctggatggaaccaaggggctgtgctgaccaagacaagactggaagtggctggagacatcattgacatcgctcaagctact gagaatcccatcactgtaaacggtggagctgaccctatcatcgccaacccgtacaccatcggcgaggtcaccatcgctgttgttga gatgccaggcttcaacatcaccgtcattgagttcttcaaactgatcgtgatcgacatcctcggaggaagatctgtaagaatcgcccc agacacagcaaacaaaggaatgatctctggcctctgtggagatcttaaaatgatggaagatacagacttcacttcagatccagaa caactcgctattcagcctaagatcaaccaggagtttgacggttgtccactctatggaaatcctgatgacgttgcatactgcaaaggtc ttctggagccgtacaaggacagctgccgcaacccatcaacttctactactacaccatctcctgcgccttcgcccgctgtatgggtgg agacgagcgagcctcacacgtgctgcttgactacagggagacgtgcgctgctcccgaaactagaggaacctgcgttttgtctggac atactttctacgatacatttgacaaagcaagataccaattccagggtcctgcaaggagattcttatggccgccgactgtttctggaa cacttgggatgtgaaggtttcacacaggaatgttgactcttacactgaagtagagaaagtacgaatcaggaaacaatcgactgtag tagaactcattgttgatggaaaacagattctggttggaggagaagccgtgtccgtcccgtacagctctcagaacacttccatctactg gcaagatggtgacatactgactacagccatcctacctgaagctctggtggtcaagttcaacttcaagcaactgctcgtcgtacatatt agagatccattcgatggtaagacttgcggtatttgcggtaactacaaccaggatttcagtgatgattcttttgatgctgaaggagcctg tgatctgacccccaacccaccgggatgcaccgaagaacagaaacctgaagctgaacgactctgcaatagtctcttcgccggtcaa agtgatcttgatcagaaatgtaacgtgtgccacaagcctgaccgtgtcgaacgatgcatgtacgagtattgcctgagggacaaca gggtttctgtgaccacgcatgggagttcaagaaagaatgctacataaagcatggagacaccctagaagtaccagatgaatgcaa -continued agagagggacgtgtcgacccctccgaccgtgcttccggacaacttccccagatacccgtgggcaagttcttccaatatgacacctgg aagcagtccacccagcgcctgcgcaggggcctgcctgccctcctgcgtgcccgccggggtcacgtgctcgccaaggagctcgagg cgttcagggaggccaaacgtcaccgtccctgattgctctacccacccaagaccccgcccacggggcgccccccagagatggcc agcaatcggaagtga Parathyroid hormone (PTH) Mouse (nucleic acid sequence):

(SEQ ID NO: 289)

atgatgtctgcaaacaccgtggctaaagtgatgatcatcatgctggcagtctgtcttcttacccaaacggatgggaaacccgtgagg<u>aag</u>

<u>aga</u>Tactgcgccactgttcattgccaggactgtccttacgaacctgatccaccaaacacagttccaacttcctgtgaagctaaagaa ggagaatgtattgatagcagctgtggcacctgcacgagagacatactatcagatggactgtgtgaaaataaaccaggaaaaaca tgttgccgaatgtgtcagtatgtaattgaatgcagagtagaggccgcaggatggtttagaacattctatggaaagagattccagttcc aggaacctggtacatacgtgtgggtcaaggaaccaagggcggcgactggaaggtgtccatcaccctggagaacctggatggaa ccaaggggctgtgctgaccaagacaagactggaagtggctggagacatcattgacatcgctcaagctactgagaatcccatca ctgtaaacggtggagctgaccctatcatcgccaacccgtacaccatcggcgaggtcaccatcgctgttgttgagatgccaggcttca acatcaccgtcattgagttcttcaaactgatcgtgatcgacatcctcggaggaagatctgtaagaatcgcccagacacagcaaac aaaggaatgatctctggcctctgtggagatcttaaaatgatggaagatacagacttcacttcagatccagaacaactcgctattcag cctaagatcaaccaggagtttgacggttgtccactctatggaaatcctgatgacgttgcatactgcaaaggtcttctggagccgtaca aggacagctgccgcaacccccatcaacttctactactacaccatctcctgcgccttcgcccgctgtatgggtggagacgagcgagcct cacacgtgctgcttgactacagggagacgtgcgctgctcccgaaactagaggaacctgcgttttgtctggacatactttctacgatac atttgacaaagcaagataccaattccagggtccctgcaaggagattcttatggccgccgactgtttctggaacacttgggatgtgaa ggtttcacacaggaatgttgactcttacactgaagtagagaaagtacgaatcaggaaacaatcgactgtagtagaactcattgttga tggaaaacagattctggttggaggagaagccgtgtccgtcccgtacagctctcagaacacttccatctactggcaagatggtgacat actgactacagccatcctacctgaagctctggtggtcaagttcaacttcaagcaactgctcgtcgtacatattagagatccattcgatg gtaagacttgcggtatttgcggtaactacaaccaggatttcagtgatgattcttttgatgctgaaggagcctgtgatctgacccccaac ccaccgggatgcaccgaagaacagaaacctgaagctgaacgactctgcaatagtctcttcgccggtcaaagtgatcttgatcaga aatgtaacgtgtgccacaagcctgaccgtgtcgaacgatgcatgtacgagtattgcctgaggggacaacagggtttctgtgaccac gcatgggagttcaagaaagaatgctacataaagcatggagacaccctagaagtaccagatgaatgcaaa<u>aagagag</u>ctgtcagt gaaatacagcttatgcacaacctgggcaaacacctggcctccatggagaggatgcaatggctgagaaggaagctgcaagatatgcac aattttgttagtcttggagtccaaatggctgccagagatggcagtcaccagaagcccaccaagaaggaggaaaatgtccttgttgatggc aatccaaaaagtcttggtgagggagacaaagctgatgtggatgtattagttaaatcaaaatctcagtaa Parathyroid hormone (PTH) Human (nucleic acid sequence):

(SEQ ID NO: 290)

atgatacctgcaaaagacatggctaaagttatgattgtcatgttggcaatttgttttcttacaaaatcggatgggaaatctgttaag<u>aagaga</u>

Tactgcgccactgttcattgccaggactgtccttacgaacctgatccaccaaacacagttccaacttcctgtgaagctaaagaagga gaatgtattgatagcagctgtggcacctgcacgagagacatactatcagatggactgtgtgaaaataaaccaggaaaaacatgtt gccgaatgtgtcagtatgtaattgaatgcagagtagaggccgcaggatggtttagaacattctatggaaagagattccagttccagg aacctggtacatacgtgtgggtcaaggaaccaagggcggcgactggaaggtgtccatcaccctggagaacctggatggaacca aggggctgtgctgaccaagacaagactggaagtggctggagacatcattgacatcgctcaagctactgagaatcccatcactgt aaacggtggagctgaccctatcatcgccaacccgtacaccatcggcgaggtcaccatcgctgttgttgagatgccaggcttcaaca tcaccgtcattgagttcttcaaactgatcgtgatcgacatcctcggaggaagatctgtaagaatcgcccagacacagcaaacaaa ggaatgatctctggcctctgtggagatcttaaaatgatggaagatacagacttcacttcagatccagaacaactcgctattcagccta agatcaaccaggagtttgacggttgtccactctatggaaatcctgatgacgttgcatactgcaaaggtcttctggagccgtacaagg acagctgccgcaacccccatcaacttctactactacaccatctcctgcgccttcgcccgctgtatgggtggagacgagcgagcctcac -continued acgtgctgcttgactacagggagacgtgcgctgctcccgaaactagaggaacctgcgttttgtctggacatactttctacgatacattt gacaaagcaagataccaattccagggtccctgcaaggagattcttatggccgccgactgtttctggaacacttgggatgtgaaggtt tcacacaggaatgttgactcttacactgaagtagagaaagtacgaatcaggaaacaatcgactgtagtagaactcattgttgatgg aaaacagattctggttggaggagaagccgtgtccgtcccgtacagctctcagaacacttccatctactggcaagatggtgacatact gactacagccatcctacctgaagctctggtggtcaagttcaacttcaagcaactgctcgtcgtacatattagagatccattcgatggta agacttgcggtatttgcggtaactacaaccaggatttcagtgatgattcttttgatgctgaaggagcctgtgatctgaccccccaaccca ccgggatgcaccgaagaacagaaacctgaagctgaacgactctgcaatagtctcttcgccggtcaaagtgatcttgatcagaaat gtaacgtgtgccacaagcctgaccgtgtcgaacgatgcatgtacgagtattgcctgaggggacaacagggtttctgtgaccacgca tgggagttcaagaaagaatgctacataaagcatggagacaccctagaagtaccagatgaatgcaaaaagagatctgtgagtgaa atacagcttatgcataacctgggaaaacatctgaactcgatggagagagtagaatggctgcgtaagaagctgcaggatgtgcacaattttt gttgcccttggagctcctctagctcccagagatgctggttcccagaggccccgaaaaaaggaagacaatgtcttggttgagagccatga aaaaagtcttggagaggcagacaaagctgatgtgaatgtattaactaaagctaaatcccagtga Parathyroid hormone-related protein (PTHrP) Mouse (nucleic acid sequence):

(SEQ ID NO: 291)

atgctgcggaggctggttcagcagtggagtgtcctggtattcctgctcagctactccgtgccctcccgcgggcgttcggtggaggggct tggccgcaggctcaaacgcTactgcgccactgttcattgccaggactgtccttacgaacctgatccaccaaacacagttccaacttc ctgtgaagctaaagaaggagaatgtattgatagcagctgtggcacctgcacgagagacatactatcagatggactgtgtgaaaat aaaccaggaaaaacatgttgccgaatgtgtcagtatgtaattgaatgcagagtagaggccgcaggatggtttagaacattctatgg aaagagattccagttccaggaacctggtacatacgtgttgggtcaaggaaccaagggcggcgactggaaggtgtccatcaccctg gagaacctgatggaaccaaggggggctgtgctgaccaagacaagactggaagtggctggagacatcattgacatcgctcaagct actgagaatcccatcactgtaaacggtggagctgacctatcatcgccaacccgtacaccatcggcgaggtcaccatcgctgttgtt gagatgccaggcttcaacatcaccgtcattgagttcttcaaactgatcgtgatcgacatcctcggaggaagatctgtaagaatcgcc ccagacacagcaaacaaggaatgatctctggcctctgtggagatcttaaaatgatggaagatacagacttcacttcagatccag aacaactcgctattcagcctaagatcaaccaggagtttgacggttgtccactctatggaaatcctgatgacgttgcatactgcaaag gtcttctggagccgtacaaggacagctgccgcaacccatcaacttctactactacaccatctcctgcgccttcgcccgctgtatggg tggagacgagcgagcctcacacgtgctgcttgactacagggagacgtgcgctgctcccgaaactagaggaacctgcgttttgtctg gacatactttctacgatacatttgacaaagcaagataccaattccagggtccctgcaaggagattcttatggccgccgactgtttctg gaacacttgggatgtgaaggtttcacacaggaatgttgactcttacactgaagtagagaaagtacgaatcaggaaacaatcgact gtagtagaactcattgttgatggaaaacagattctggttggaggagaagccgtgtccgtcccgtacagctctcagaacacttccatct actggcaagatggtgacatactgactacagccatcctacctgaagctctggtggtcaagttcaacttcaagcaactgctcgtcgtac atattagagatccattcgatggtaagacttgcggtatttgcggtaactacaaccaggatttcagtgatgattcttttgatgctgaaggag cctgtgatctgaccccccaaccccacgggatgcaccgaagaacagaaacctgaagctgaacgactctgcaatagtctcttcgccgg tcaaagtgatcttgatcagaaatgtaacgtgtgccacaagcctgaccgtgtcgaacgatgcatgtacgagtattgcctgaggggac aacagggtttctgtgaccacgcatgggagttcaagaaagaatgctacataaagcatggagacaccctagaagtaccagatgaat gcaaaaacgcgctgtgtctgaacatcagctactgcatgacaagggcaagtccatccaagacttgcgccgccgtttcttcctccaccat ctgatcgcggagatccacacagccgaaatcagagctacctcggaggtgtccccaactccaaacctgctcccaacaccaaaaaccac cccgtgcggtttgggtcagacgatgagggcagatacctaactcaggaaaccaacaaggtggagacgtacaaagaacagccactcaa gacacccggaagaagaagaaaggcaagcctgggaaacgcagagaacaggagaaaagaagcgaaggactcggtctgcctggc caagcacagctgcgagtggcctgcttgaggaccccctgccccacacctccaggccctcgctggagcccagcttaaggacgcattga Parathyroid hormone-related protein (PTHrP) Human (nucleic acid sequence):

(SEQ ID NO: 292)

atgcagcggagactggttcagcagtggagcgtcgcggtgttcctgctgagctacgcggtgccctcctgcgggcgctcggtggaggt ctcagccgccgcctcaaaagaTactgcgccactgttcattgccaggactgtccttacgaacctgatccaccaaacacagttccaactt

```
cctgtgaagctaaagaaggagaatgtattgatagcagctgtggcacctgcacgagagacatactatcagatggactgtgtgaaaa taaaccaggaaaaacatgttgccgaatgtgtcagtatgtaattgaatgcagagtagaggccgcaggatggtttagaacattctatg gaaagagattccagttccaggaacctggtacatacgtgtttgggtcaaggaaccaagggcggcgactggaaggtgtccatcaccct ggagaacctggatggaaccaagggggctgtgctgaccaagacaagactggaagtggctggagacatcattgacatcgctcaag ctactgagaatcccatcactgtaaacggtggagctgaccctatcatcgccaacccgtacaccatcggcgaggtcaccatcgctgttg ttgagatgccaggcttcaacatcaccgtcattgagttcttcaaactgatcgtgatcgacatcctcggaggaagatctgtaagaatcgc cccagacacagcaaacaaggaatgatctctggcctctgtggagatcttaaaatgatggaagatacagacttcacttcagatccag aacaactcgctattcagcctaagatcaaccaggagtttgacggttgtccactctatggaaatcctgatgacgttgcatactgcaaag gtcttctggagccgtacaaggacagctgccgcaacccatcaacttctactactacaccatctcctgcgccttcgcccgctgtatggg tggagacgagcgagcctcacacgtgctgcttgactacagggagacgtgcgctgctcccgaaactagaggaacctgcgttttgtctg gacatactttctacgatacatttgacaaagcaagataccaattccagggtccctgcaaggagattcttatggccgccgactgtttctg gaacacttgggatgtgaaggtttcacacaggaatgttgactcttacactgaagtagagaaagtacgaatcaggaaacaatcgact gtagtagaactcattgttgatggaaaacagattctggttggaggagaagccgtgtccgtcccgtacagctctcagaacacttccatct actggcaagatggtgacatactgactacagccatcctacctgaagctctggtggtcaagttcaacttcaagcaactgctcgtcgtac atattagagatccattcgatggtaagacttgcggtatttgcggtaactacaaccaggatttcagtgatgattcttttgatgctgaaggag cctgttgatctgaccccaacccaccgggatgcaccgaagaacagaaacctgaagctgaacgactctgcaatgtctcttcgccgg tcaaagtgatcttgatcagaaatgtaacgtgtgccacaagcctgaccgtgtcgaacgatgcatgtacgagtattgcctgagggac aacagggtttctgtgaccacgcatgggagttcaagaaagaatgctacataaagcatggagacaccctagaagtaccagatgaat gcaaaaaaagagctgtgtctgaacatcagctcctccatgacaaggggaagtccatccaagatttacggcgacgattcttccttcaccatc tgatcgcagaaatccacacagctgaaatcagagctacctcggaggtgtccctaactccaagccctctcccaacacaaagaaccaccc cgtccgatttgggtctgatgatgagggcagatacctaactcaggaaactaacaaggtggaagacgtacaaagagcagccgctcaagac acctgggaagaaaagaaaggcaagcccgggaaacgcaaggagcaggaaaagaaaaaacggcgaactcgctctgcctggttaga ctctggagtgactgggagtgggctagaaggggaccacctgtctgacacctccacaacgtcgctggagctcgattcacggaggcattga
```

Osteocalcin Mouse (nucleic acid sequence):

(SEQ ID NO: 293)
```
atgaggaccatctttctgctcactctgctgaccctggctgcgctctgtctctctgacctcacagatgccaagcccagcggccctgagtctg acaaagccttcatgtccaagcaggagggcaataaggtagtgaacagactccggcgcTactgcgccactgttcattgccaggactgtc cttacgaacctgatccaccaaacacagttccaacttcctgtgaagctaaagaaggagaatgtattgatagcagctgtggcacctgc acgagagacatactatcagatggactgtgtgaaaataaaccaggaaaaacatgttgccgaatgtgtcagtatgtaattgaatgcag agtagaggccgcaggatggtttagaacattctatggaaagagattccagttccaggaacctggtacatacgtgtttgggtcaaggaa ccaagggcggcgactggaaggtgtccatcaccctggagaacctggatggaaccaagggggctgtgctgaccaagacaagactg gaagtggctggagacatcattgacatcgctcaagctactgagaatcccatcactgtaaacggtggagctgaccctatctcgccaa cccgtacaccatcggcgaggtcaccatcgctgttgttgagatgccaggcttcaacatcaccgtcattgagttcttcaaactgatcgtga tcgacatcctcggaggaagatctgtaagaatcgcccagacacagcaaacaaggaatgatctctggcctctgtggagatcttaa aatgatggaagatacagacttcacttcagatccagaacaactcgctattcagcctaagatcaaccaggagtttgacggttgtccact ctatggaaatcctgatgacgttgcatactgcaaaggtcttctggagccgtacaaggacagctgccgcaacccatcaacttctacta ctacaccatctcctgcgccttcgcccgctgtatgggtggagacgagcgagcctcacacgtgctgcttgactacagggagacgtgcg ctgctcccgaaactagaggaacctgcgttttgtctggacatactttctacgatacatttgacaaagcaagataccaattccagggtcc ctgcaaggagattcttatggccgccgactgtttctggaacacttgggatgtgaaggtttcacacaggaatgttgactcttacactgaa gtagagaaagtacgaatcaggaaacaatcgactgtagtagaactcattgttgatggaaaacagattctggttggaggagaagccg tgtccgtcccgtacagctctcagaacacttccatctactggcaagatggtgacatactgactacagccatcctacctgaagctctggt
```

-continued ggtcaagttcaacttcaagcaactgctcgtcgtacatattagagatccattcgatggtaagacttgcggtatttgcggtaactacaacc
aggatttcagtgatgattcttttgatgctgaaggagcctgtgatctgaccccaacccaccgggatgcaccgaagaacagaaacct
gaagctgaacgactctgcaatagtctcttcgccggtcaaagtgatcttgatcagaaatgtaacgtgtgccacaagcctgaccgtgtc
gaacgatgcatgtacgagtattgcctgaggggacaacagggtttctgtgaccacgcatgggagttcaagaaagaatgctacataa
agcatggagacaccctagaagtaccagatgaatgcaaacggcgctaccttggagcctcagtccccagcccagatccctggagcc
cacccgggagcagtgtgagcttaaccctgcttgtgacgagctatcagaccagtatggcttgaagaccgcctacaaacgcatctatggtat
cactatttag Osteocalcin Human (nucleic acid sequence):

(SEQ ID NO: 294)

atgagagccctcacactcctcgccctattggccctggccgcactttgcatcgctggccaggcaggtgcgaagcccagcggtgcagagt
ccagcaaaggtgcagcctttgtgtccaagcaggagggcagcgaggtagtgaagagacccaggcgcTactgcgccactgttcattgc
caggactgtccttacgaacctgatccaccaaacacagttccaacttcctgtgaagctaaagaaggagaatgtattgatagcagctgt
ggcacctgcacgagagacatactatcagatggactgtgtgaaaataaaccaggaaaaacatgttgccgaatgtgtcagtatgtaa
ttgaatgcagagtagaggccgcaggatggtttagaacattctatggaaagagattccagttccaggaacctggtacatacgtgttgg
gtcaaggaaccaagggcggcgactggaaggtgtccatcaccctggagaacctggatggaaccaagggggctgtgctgaccaa
gacaagactggaagtggctggagacatcattgacatcgctcaagctactgagaatcccatcactgtaaacggtggagctgacact
atcatcgccaacccgtacaccatcggcgaggtcaccatcgctgttgttgagatgccaggcttcaacatcaccgtcattgagttcttca
aactgatcgtgatcgacatcctcggaggaagatctgtaagaatcgcccagacacagcaaacaaaggaatgatctctggcctctg
tggagatcttaaaatgatggaagatacagacttcacttcagatccagaacaactcgctattcagcctaagatcaaccaggagttga
cggttgtccactctatggaaatcctgatgacgttgcatactgcaaaggtcttctggagccgtacaaggacagctgccgcaacccat
caacttctactactacaccatctcctgcgccttcgcccgctgtatgggtggagacgagcgagcctcacacgtgctgcttgactacagg
gagacgtgcgctgctcccgaaactagaggaacctgcgttttgtctggacatactttctacgatacatttgacaaagcaagataccaa
ttccagggtccctgcaaggagattcttatggccgccgactgtttctggaacacttgggatgtgaaggttttcacacaggaatgttgactc
ttacactgaagtagagaaagtacgaatcaggaaacaatcgactgtagtagaactcattgttgatggaaaacagattctggttggag
gagaagccgtgtccgtcccgtacagctctcagaacacttccatctactggcaagatggtgacatactgactacagccatcctacctg
aagctctggtggtcaagttcaacttcaagcaactgctcgtcgtacatattagagatccattcgatggtaagacttgcggtatttgcggt
aactacaaccaggatttcagtgatgattcttttgatgctgaaggagcctgtgatctgaccccaacccaccgggatgcaccgaaga
acagaaacctgaagctgaacgactctgcaatagtctcttcgccggtcaaagtgatcttgatcagaaatgtaacgtgtgccacaagc
ctgaccgtgtcgaacgatgcatgtacgagtattgcctgaggggacaacagggtttctgtgaccacgcatgggagttcaagaaaga
atgctacataaagcatggagacaccctagaagtaccagatgaatgcaaaaggcgctacctgtatcaatggctgggagccccagtc
ccctacccggatccctggagcccaggagggaggtgtgtgagctcaatccggactgtgacgagttggctgaccacatcggctttcagg
aggcctatcggcgcttctacgcccggtctag Urocortin-3 Mouse (nucleic acid sequence):

(SEQ ID NO: 295)

atgctgatgccacctacttcctgctgccacttctgctgctcctaggaggtccaaggacaagcctctcccacaagttctacaacactg
gaccagtcttcagctgcctcaacacagccctatcgaggtcaagaagaacaagctggaagatgtgcccttgctgagcaagaaga
gctttggccacctgcccacacaagacccctcaggggaagaagatgacaaccaaacgcacctccagatcaaaagaactttctcag
gtgccgcgggtgggaatggagctgggagcaccggtacagataccaatcccaggcacagcacaaggggaagctgtacccaga
caagcccaaaagcgaccggggcaccaagTactgcgccactgttcattgccaggactgtccttacgaacctgatccaccaaacac
agttccaacttcctgtgaagctaaagaaggagaatgtattgatagcagctgtggcacctgcacgagagacatactatcagatggac
tgtgtgaaaataaaccaggaaaaacatgttgccgaatgtgtcagtatgtaattgaatgcagagtagaggccgcaggatggtttaga
acattctatggaaagagattccagttccaggaacctggtacatacgtgttgggtcaaggaaccaagggcggcgactggaaggtgt
ccatcaccctggagaacctggatggaaccaagggggctgtgctgaccaagacaagactggaagtggctggagacatcattgac -continued atcgctcaagctactgagaatcccatcactgtaaacggtggagctgaccctatcatcgccaacccgtacaccatcggcgaggtcac catcgctgttgttgagatgccaggcttcaacatcaccgtcattgagttcttcaaactgatcgtgatcgacatcctcggaggaagatctg taagaatcgccccagacacagcaaacaaaggaatgatctctggcctctgtggagatcttaaaatgatggaagatacagacttcac ttcagatccagaacaactcgctattcagcctaagatcaaccaggagtttgacggttgtccactctatggaaatcctgatgacgttgca tactgcaaaggtcttctggagccgtacaaggacagctgccgcaacccatcaacttctactactacaccatctcctgcgccttcgccc gctgtatggtggagacgagcgagcctcacacgtgctgcttgactacagggagacgtgcgctgctcccgaaactagaggaacct gcgttttgtctggacatactttctacgatacatttgacaaagcaagataccaattccagggtcctgcaaggagattcttatggccgcc gactgtttctggaacacttgggatgtgaaggtttcacacaggaatgttgactcttacactgaagtagagaaagtacgaatcaggaaa caatcgactgtagtagaactcattgttgatggaaaacagattctggttggaggagaagccgtgtccgtcccgtacagctctcagaac acttccatctactggcaagatggtgacatactgactacagccatcctacctgaagctctggtggtcaagttcaacttcaagcaactgc tcgtcgtacatattagagatccattcgatggtaagacttgcggtatttgcggtaactacaaccaggatttcagtgatgattcttttgatgc tgaaggagcctgtgatctgaccccaaacccaccgggatgcaccgaagaacagaaacctgaagctgaacgactctgcaatagtct cttcgccggtcaaagtgatcttgatcagaaatgtaacgtgtgccacaagcctgaccgtgtcgaacgatgcatgtacgagtattgcct gaggggacaacagggtttctgtgaccacgcatgggagttcaagaaagaatgctcataaagcatggagacaccctagaagtac cagatgaatgcaaacgggqcaccaagttcaccctttcccttgatgttcccactaacatcatgaacatcctcttcaacatcgacaaggcca agaatttgcgagccaaggcagctgccaatgctcagctcatggcacagattgggaagaagaagtaa Urocortin-3 Human (nucleic acid sequence):

(SEQ ID NO: 296)

Atgctgatgccggtccacttcctgctgctcctgctgctgctcctgggggcccccaggacaggcctccccacaagttctacaaagcc aagcccatcttcagctgcctcaacaccgccctgtctgaggctgagaagggccagtgggaggatgcatccctgctgagcaagagg agcttccactacctgcgcagcagagacgcctcttcgggagaggaggaggagggcaaagagaaaaagactttccccatctctggg gccaggggtggagcagaggcacccggtacagatacgtgtcccaagcacagcccaggggaaagccacgccaggacacggcc aagagtccccaccgcTactgcgccactgttcattgccaggactgtccttacgaacctgatccaccaaacacagttccaacttcctgt gaagctaaagaaggagaatgtattgatagcagctgtggcacctgcacgagagacatactatcagatggactgtgaaaataaa ccaggaaaaacatgttgccgaatgtgtcagtatgtaattgaatgcagagtagaggccgcaggatggtttagaacattctatggaaa gagattccagttccaggaacctggtacatacgtgttgggtcaaggaaccaagggcggcgactggaaggtgtccatcaccctggag aacctggatggaaccaagggggctgtgctgaccaagacaagactggaagtggctggagacatcattgacatcgctcaagctact gagaatcccatcactgtaaacggtggagctgaccctatcatcgccaacccgtacaccatcggcgaggtcaccatcgctgttgttga gatgccaggcttcaacatcaccgtcattgagttcttcaaactgatcgtgatcgacatcctcggaggaagatctgtaagaatcgcccc agacacagcaaacaaaggaatgatctctggcctctgtggagatcttaaaatgatggaagatacagacttcacttcagatccagaa caactcgctattcagcctaagatcaaccaggagtttgacggttgtccactctatggaaatcctgatgacgttgcatactgcaaaggtc ttctggagccgtacaaggacagctgccgcaacccatcaacttctactactacaccatctcctgcgccttcgcccgctgtatggtgg agacgagcgagcctcacacgtgctgcttgactacagggagacgtgcgctgctcccgaaactagaggaacctgcgttttgtctggac atactttctacgatacatttgacaaagcaagataccaattccagggtcctgcaaggagattcttatggccgccgactgtttctggaa cacttgggatgtgaaggtttcacacaggaatgttgactcttacactgaagtagagaaagtacgaatcaggaaacaatcgactgtag tagaactcattgttgatggaaaacagattctggttggaggagaagccgtgtccgtcccgtacagctctcagaacacttccatctactg gcaagatggtgacatactgactacagccatcctacctgaagctctggtggtcaagttcaacttcaagcaactgctcgtcgtacatatt agagatccattcgatggtaagacttgcggtatttgcggtaactacaaccaggatttcagtgatgattcttttgatgctgaaggagcctg tgatctgaccccaaacccaccgggatgcaccgaagaacagaaacctgaagctgaacgactctgcaatagtctcttcgccggtcaa agtgatcttgatcagaaatgtaacgtgtgccacaagcctgaccgtgtcgaacgatgcatgtacgagtattgcctgaggggacaaca gggtttctgtgaccacgcatgggagttcaagaaagaatgctcataaagcatggagacaccctagaagtaccagatgaatgcaa -continued a<u>caccgc</u>accaagttcaccctgtccctcgacgtccccaccaacatcatgaacctcctcttcaacatcgccaaggccaagaacctgcgtg
cccaggcggccgccaatgcccacctgatggcgcaaattggaggaagaagtag Urocortin-2 Mouse (nucleic acid sequence):

(SEQ ID NO: 297)

Atgatgaccaggtgggcactggtggtgttcgtggtcctgatgttggataggatcctatttgtcccaggaactcctatccccaccttccagc tcctccctcagaactctctggagacaactcctagctctgtgacctcagagagctcctcaggtaccaccacaggaccctcagcttcctgga gcaactctaaagccagcccttacctagac<u>acccgtgtc</u>T*actgcgccactgttcattgccaggactgtccttacgaacctgatccacca*

*aacacagttccaacttcctgtgaagctaaagaaggagaatgtattgatagcagctgtggcacctgcacgagagacatactatcag*

*atggactgtgtgaaaataaaccaggaaaaacatgttgccgaatgtgtcagtatgtaattgaatgcagagtagaggccgcaggatg*

*gtttagaacattctatggaaagagattccagttccaggaacctggtacatacgtgtgggtcaaggaaccaagggcggcgactgga*

*aggtgtccatcaccctggagaacctggatggaaccaaggggctgtgctgaccaagacaagactggaagtggctggagacatc*

*attgacatcgctcaagctactgagaatcccatcactgtaaacggtggagctgacctatcatcgccaacccgtacaccatcggcga*

*ggtcaccatcgctgttgttgagatgccaggcttcaacatcaccgtcattgagttcttcaaactgatcgtgatcgacatcctcggaggaa*

*gatctgtaagaatcgcccagacacagcaaacaaaggaatgatctctggcctctgtggagatcttaaaatgatggaagatacaga*

*cttcacttcagatccagaacaactcgctattcagcctaagatcaaccaggagtttgacggttgtccactctatggaaatcctgatgac*

*gttgcatactgcaaaggtcttctggagccgtacaaggacagctgccgcaacccccatcaacttctactactacaccatctcctgcgcct*

*tcgcccgctgtatgggtggagacgagcgagcctcacacgtgctgcttgactacagggagacgtgcgctgctcccgaaactagagg*

*aacctgcgttttgtctggacatactttctacgatacatttgacaaagcaagataccaattccagggtccctgcaaggagattcttatgg*

*ccgccgactgtttctggaacacttgggatgtgaaggttcacacaggaatgttgactcttacactgaagtagagaaagtacgaatca*

*ggaaacaatcgactgtagtagaactcattgttgatgaaaacagattctggttggaggagaagccgtgtccgtcccgtacagctctc*

*agaacacttccatctactggcaagatggtgacatactgactacagccatcctacctgaagctctggtggtcaagttcaacttcaagc*

*aactgctcgtcgtacatattagagatccattcgatggtaagacttgcggtatttgcggtaactacaaccaggatttcagtgatgattctttt*

*tgatgctgaaggagcctgtgatctgaccccaacccaccgggatgcaccgaagaacagaaacctgaagctgaacgactctgcaa*

*tagtctcttcgccggtcaaagtgatcttgatcagaaatgtaacgtgtgccacaagcctgaccgtgtcgaacgatgcatgtacgagtat*

*tgcctgaggggacaacagggtttctgtgaccacgcatgggagttcaagaaagaatgctacataaagcatggagacaccctagaa*

*gtaccagatgaatgcaaa<u>acccgtgt</u>catactctccctggatgttcccattggcctcctacggatcttactggaacaggctcgttacaag* gctgccaggaatcaggctgccactaatgctcaaatactagcccatgttggccgccgctga

Urocortin-2 Human (nucleic acid sequence):

(SEQ ID NO: 298)

atgaccaggtgtgctctgctgttgctgatggtcctgatgttgggcagagtcctggttgtcccagtgaccccctatccaaccttccagctccg ccctcagaattctccccagaccactccccgacctgcggcctcagagagcccctcagctgctcccacatggccgtgggctgcccagag ccactgcagccccaccccgccaccctggc<u>tcgcgcatt</u>T*actgcgccactgttcattgccaggactgtccttacgaacctgatccacca*

*aacacagttccaacttcctgtgaagctaaagaaggagaatgtattgatagcagctgtggcacctgcacgagagacatactatcag*

*atggactgtgtgaaaataaaccaggaaaaacatgttgccgaatgtgtcagtatgtaattgaatgcagagtagaggccgcaggatg*

*gtttagaacattctatggaaagagattccagttccaggaacctggtacatacgtgttgggtcaaggaaccaagggcggcgactgga*

*aggtgtccatcaccctggagaacctggatggaaccaaggggctgtgctgaccaagacaagactggaagtggctggagacatc*

*attgacatcgctcaagctactgagaatcccatcactgtaaacggtggagctgacctatcatcgccaacccgtacaccatcggcga*

*ggtcaccatcgctgttgttgagatgccaggcttcaacatcaccgtcattgagttcttcaaactgatcgtgatcgacatcctcggaggaa*

*gatctgtaagaatcgccccagacacagcaaacaaaggaatgatctctggcctctgtggagatcttaaaatgatggaagatacaga*

*cttcacttcagatccagaacaactcgctattcagcctaagatcaaccaggagtttgacggttgtccactctatggaaatcctgatgac*

*gttgcatactgcaaaggtcttctggagccgtacaaggacagctgccgcaacccccatcaacttctactactacaccatctcctgcgcct*

*tcgcccgctgtatgggtggagacgagcgagcctcacacgtgctgcttgactacagggagacgtgcgctgctcccgaaactagagg*

*aacctgcgttttgtctggacatactttctacgatacatttgacaaagcaagataccaattccagggtccctgcaaggagattcttatgg*

-continued ccgccgactgtttctggaacacttgggatgtgaaggtttcacacaggaatgttgactcttacactgaagtagagaaagtacgaatca ggaaacaatcgactgtagtagaactcattgttgatgaaaacagattctggttggaggagaagccgtgtccgtcccgtacagctctc agaacacttccatctactggcaagatggtgacatactgactacagccatcctacctgaagctctggtggtcaagttcaacttcaagc aactgctcgtcgtacatattagagatccattcgatggtaagacttgcggtatttgcggtaactacaaccaggatttcagtgatgattcttt tgatgctgaaggagcctgtgatctgaccccaacccaccgggatgcaccgaagaacagaaacctgaagctgaacgactctgcaa tagtctcttcgccggtcaaagtgatcttgatcagaaatgtaacgtgtgccacaagcctgaccgtgtcgaacgatgcatgtacgagtat tgcctgagggacaacagggtttctgtgaccacgcatggagttcaagaaagaatgctacataaagcatggagacaccctagaa gtaccagatgaatgcaaat<u>cgcgcatt</u>gtcctatcgctggatgtccccatcggcctcttgcagatcttactggagcaagcccgggccag ggctgccagggagcaggccaccaccaacgcccgcatcctggcccgtgtcggccactgctga Urocortin-1 Mouse (nucleic acid sequence):

(SEQ ID NO: 299)

Atgatacagaggggacgcgctacgctcctggtggcgttgctgctcttggcacagcttcgcccggagagcagccagtggagcccagc ggctgcggcggcaactggggtccaggatccgaatctgcgatggagccctggagtgcggaatcagggcggcggcgtccgcgcgctc ctcttgctgttagcggagcgcttcccgcgccgcgcaggatctgagcctgcgggcgagcggcag<u>cgacgg</u>Tactgcgccactgttcat tgccaggactgtccttacgaacctgatccaccaaacacagttccaacttcctgtgaagctaaagaaggagaatgtattgatagcag ctgtggcacctgcacgagagacatactatcagatggactgtgtgaaaataaaccaggaaaaacatgttgccgaatgtgtcagtatg taattgaatgcagagtagaggccgcaggatggtttagaacattctatggaaagagattccagttccaggaacctggtacatacgtgt tgggtcaaggaaccaagggcggcgactggaaggtgtccatcaccctggagaacctggatggaaccaaggggctgtgctgacc aagacaagactggaagtggctggagacatcattgacatcgctcaagctactgagaatcccatcactgtaaacggtggagctgacc ctatcatcgccaacccgtacaccatcggcgaggtcaccatcgctgttgttgagatgccaggcttcaacatcaccgtcattgagttcttc aaactgatcgtgatcgacatcctcggaggaagatctgtaagaatcgcccagacacagcaaacaaggaatgatctctggcctct gtggagatcttaaaatgatggaagatacagacttcacttcagatccagaacaactcgctattcagcctaagatcaaccaggagtttg acggttgtccactctatggaaatcctgatgacgttgcatactgcaaaggtcttctggagccgtacaaggacagctgccgcaaccca tcaacttctactactacaccatctcctgcgccttcgcccgctgtatggtggagacgagcagcctcacacgtgctgcttgactacag ggagacgtgcgctgctcccgaaactagaggaacctgcgttttgtctggacatactttctacgatacatttgacaaagcaagatacca attccagggtccctgcaaggagattcttatgccgccgactgtttctggaacacttgggatgtgaaggtttcacacaggaatgttgact cttacactgaagtagagaaagtacgaatcaggaaacaatcgactgtagtagaactcattgttgatgaaaacagattctggttgga ggagaagccgtgtccgtcccgtacagctctcagaacacttccatctactggcaagatggtgacatactgactacagccatcctacct gaagctctggtggtcaagttcaacttcaagcaactgctcgtcgtacatattagagatccattcgatggtaagacttgcggtatttgcgg taactacaaccaggatttcagtgatgattcttttgatgctgaaggagcctgtgatctgaccccaacccaccgggatgcaccgaaga acagaaacctgaagctgaacgactctgcaatagtctcttcgccggtcaaagtgatcttgatcagaaatgtaacgtgtgccacaagc ctgaccgtgtcgaacgatgcatgtacgagtattgcctgagggacaacagggtttctgtgaccacgcatggagttcaagaaaga atgctacataaagcatggagacaccctagaagtaccagatgaatgcaaa<u>cgacgg</u>acgaccctccactgtccatcgacctcacc ttccacctgctgcggacccctgctggagctagctcggacacagagccagcgcgagcgcgcagagcagaaccgcatcatattcgattcg gtgggcaagtga Urocortin-1 Human (nucleic acid sequence):

(SEQ ID NO: 300)

atgaggcaggcgggacgcgcagcgctgctggccgcgctgctgctcctggtacagctgtgccctgggagcagccagaggagccccg aggcggccggggtccaggaccgagtctgcgctggagccccggggcacggaaccagggtggcggggcccgcgcgctcctcttgc tgctggcggagcgcttcccgcgccgcgcggggcccggccgattgggactcgggacggcaggcgagcggcc<u>cggcgg</u>Tactgc gccactgttcattgccaggactgtccttacgaacctgatccaccaaacacagttccaacttcctgtgaagctaaagaaggagaatgt attgatagcagctgtggcacctgcacgagagacatactatcagatggactgtgtgaaaataaaccaggaaaaacatgttgccgaa -continued tgtgtcagtatgtaattgaatgcagagtagaggccgcaggatggtttagaacattctatggaaagagattccagttccaggaacctg gtacatacgtgttgggtcaaggaaccaagggcggcgactggaaggtgtccatcaccctggagaacctggatggaaccaagggg gctgtgctgaccaagacaagactggaagtggctggagacatcattgacatcgctcaagctactgagaatcccatcactgtaaacg gtggagctgaccctatcatcgccaacccgtacaccatcggcgaggtcaccatcgctgttgttgagatgccaggcttcaacatcaccg tcattgagttcttcaaactgatcgtgatcgacatcctcggaggaagatctgtaagaatcgccccagacacagcaaacaaaggaatg atctctggcctctgtggagatcttaaaatgatggaagatacagacttcacttcagatccagaacaactcgctattcagcctaagatca accaggagtttgacggttgtccactctatggaaatcctgatgacgttgcatactgcaaaggtcttctggagccgtacaaggacagct gccgcaaccccatcaacttctactactacaccatctcctgcgccttcgcccgctgtatgggtggagacgagcgagcctcacacgtgc tgcttgactacagggagacgtgcgctgctcccgaaactagaggaacctgcgttttgtctggacatactttctacgatacatttgacaa agcaagataccaattccagggtccctgcaaggagattcttatggccgccgactgtttctggaacacttgggatgtgaaggtttcaca caggaatgttgactcttacactgaagtagagaaagtacgaatcaggaaacaatcgactgtagtagaactcattgttgatggaaaac agattctggttggaggagaagccgtgtccgtcccgtacagctctcagaacacttccatctactggcaagatggtgacatactgacta cagccatcctacctgaagctctggtggtcaagttcaacttcaagcaactgctcgtcgtacatattagagatccattcgatggtaagact tgcggtatttgcggtaactacaaccaggatttcagtgatgattcttttgatgctgaaggagcctgtgatctgaccccccaacccaccgg gatgcaccgaagaacagaaacctgaagctgaacgactctgcaatagtctcttcgccggtcaaagtgatcttgatcagaaatgtaac gtgtgccacaagcctgaccgtgtcgaacgatgcatgtacgagtattgcctgaggggacaacagggtttctgtgaccacgcatggga gttcaagaaagaatgctacataaagcatggagacaccctagaagtaccagatgaatgcaaa<u>cggcgg</u>gacaacccttctctgtcc attgacctcacctttcacctgctgcggaccctgctggagctggcgcggacgcagagccagcgggagcgcgccgagcagaaccgcat catattcgactcggtgggcaagtga FGF23 Mouse (nucleic acid sequence):

(SEQ ID NO: 301)

Atgctagggacctgccttagactcctggtgggcgtgctctgcactgtctgcagcttgggcactgctagagcctatccggacacttcccc attgcttggctccaactggggaagcctgacccacctgtacacggctacagccaggaccagctatcacctacagatccatagggatggtc atgtagatggcacccccatcagaccatctacagtgccctgatgattacatcagaggacgccggctctgtggtgataacaggagccatg actcgaaggttcctttgtatggatctccacggcaacattttggatcgcttcacttcagcccagagaattgcaagttccgccagtggacgct ggagaatggctatgacgtctacttgtcgcagaagcatcactacctggtgagcctgggccgcgccaagcgcatcttccagccgggcacc aacccgccgcccttctcccagttcctggctcgcaggaacgaggtcccgctgctgcatttctacactgttcgcccacggcgccacacgcg cagctactgcgccactgttcattgccaggactgtccttacgaacctgatccaccaaacacagttccaacttcctgtgaagctaaagaa ggagaatgtattgatagcagctgtggcacctgcacgagagacatactatcagatggactgtgtgaaaataaaccaggaaaaaca tgttgccgaatgtgtcagtatgtaattgaatgcagagtagaggccgcaggatggtttagaacattctatggaaagagattccagttcc aggaacctggtacatacgtgttgggtcaaggaaccaagggcggcgactggaaggtgtccatcaccctggagaacctggatggaa ccaaggggctgtgctgaccaagacaagactggaagtggctggagacatcattgacatcgctcaagctactgagaatcccatca ctgtaaacggtggagctgaccctatcatcgccaacccgtacaccatcggcgaggtcaccatcgctgttgttgagatgccaggcttca acatcaccgtcattgagttcttcaaactgatcgtgatcgacatcctcggaggaagatctgtaagaatcgccccagacacagcaaac aaaggaatgatctctggcctctgtggagatcttaaaatgatggaagatacagacttcacttcagatccagaacaactcgctattcag cctaagatcaaccaggagtttgacggttgtccactctatggaaatcctgatgacgttgcatactgcaaaggtcttctggagccgtaca aggacagctgccgcaaccccatcaacttctactactacaccatctcctgcgccttcgcccgctgtatgggtggagacgagcgagcct cacacgtgctgcttgactacagggagacgtgcgctgctcccgaaactagaggaacctgcgttttgtctggacatactttctacgatac atttgacaaagcaagataccaattccagggtccctgcaaggagattcttatggccgccgactgtttctggaacacttgggatgtgaa ggtttcacacaggaatgttgactcttacactgaagtagagaaagtacgaatcaggaaacaatcgactgtagtagaactcattgttga tggaaaacagattctggttggaggagaagccgtgtccgtcccgtacagctctcagaacacttccatctactggcaagatggtgacat actgactacagccatcctacctgaagctctggtggtcaagttcaacttcaagcaactgctcgtcgtacatattagagatccattcgatg -continued gtaagacttgcggtatttgcggtaactacaaccaggatttcagtgatgattcttttgatgctgaaggagcctgtgatctgaccccaac ccaccgggatgcaccgaagaacagaaacctgaagctgaacgactctgcaatagtctcttcgccggtcaaagtgatcttgatcaga aatgtaacgtgtgccacaagcctgaccgtgtcgaacgatgcatgtacgagtattgcctgaggggacaacagggtttctgtgaccac gcatgggagttcaagaaagaatgctacataaagcatggagacaccctagaagtaccagatgaatgcaaacgcagcgccgagg acccaccggagcgcgacccactgaacgtgctcaagccgcggccccgcgccacgcctgtgcctgtatcctgctctcgcgagctgccg agcgcagaggaaggtggccccgcagccagcgatcctctgggggtgctgcgcagaggccgtggagatgctcgcggggcgcggg aggcgcggataggtgtcgccccttttccaggttcgtctag FGF23 Human (nucleic acid sequence):

(SEQ ID NO: 302)

Atgttgggggcccgcctcaggctctgggtctgtgccttgtgcagcgtctgcagcatgagcgtcctcagagcctatcccaatgcctccc cactgctcggctccagctggggtggcctgatccacctgtacacagccacagccaggaacagctaccacctgcagatccacaaga atggccatgtggatggcgcacccatcagaccatctacagtgccctgatgatcagatcagaggatgctggctttgtggtgattacag gtgtgatgagcagaagatacctctgcatggatttcagaggcaacattttttggatcacactatttcgaccggagaactgcaggttcca acaccagacgctggaaaacgggtacgacgtctaccactctcctcagtatcacttcctggtcagtctgggccgggcgaagagagcct tcctgccaggcatgaacccaccccgtactcccagtcctgtcccggaggaacgagatcccctaattcacttcaacaccccatac cacggcggcacaccgagctactgcgccactgttcattgccaggactgtccttacgaacctgatccaccaaacacagttccaactt cctgtgaagctaaagaaggagaatgtattgatagcagctgtggcacctgcacgagagacatactatcagatggactgtgtgaaaa taaaccaggaaaaacatgttgccgaatgtgtcagtatgtaattgatgcagagtagaggccgcaggatggtttagaacattctatg gaaagagattccagttccaggaacctggtacatacgtgtgggtcaaggaaccaagggcggcgactggaaggtgtccatcacccct ggagaacctggatggaaccaaggggctgtgctgaccaagacaagactggaagtggctggagacatcattgacatcgctcaag ctactgagaatcccatcactgtaaacggtggagctgaccctatcatcgccaacccgtacaccatcggcgaggtcaccatcgctgttg ttgagatgccaggcttcaacatcaccgtcattgagttcttcaaactgatcgtgatcgacatcctcggaggaagatctgtaagaatcgc cccagacacagcaaacaaggaatgatctctggcctctgtggagatcttaaaatgatggaagatacagacttcacttcagatccag aacaactcgctattcagcctaagatcaaccaggagtttgacggttgtccactctatggaaatcctgatgacgttgcatactgcaaag gtcttctggagccgtacaaggacagctgccgcaacccatcaacttctactactacaccatctcctgcgccttcgcccgctgtatggg tggagacgagcgagcctcacacgtgctgcttgactacaggggagacgtgcgctgctcccgaaactagaggaacctgcgttttgtctg gacatactttctacgatacatttgacaaagcaagataccaattccagggtccctgcaaggagattcttatggccgccgactgtttctg gaacacttgggatgtgaaggtttcacaaggaatgttgactcttacactgaagtagagaaagtacgaatcaggaaacaatcgact gtagtagaactcattgttgatggaaaacagattctggttggaggagaagccgtgtccgtcccgtacagctctcagaacacttccatct actggcaagatggtgacatactgactacagccatcctacctgaagctctggtggtcaagttcaacttcaagcaactgctcgtcgtac atattagagatccattcgatggtaagacttgcggtatttgcggtaactacaaccaggatttcagtgatgattcttttgatgctgaaggag cctgtgatctgaccccaacccaccgggatgcaccgaagaacagaaacctgaagctgaacgactctgcaatagtctcttcgccgg tcaaagtgatcttgatcagaaatgtaacgtgtgccacaagcctgaccgtgtcgaacgatgcatgtacgagtattgcctgaggggac aacagggtttctgtgaccacgcatgggagttcaagaaagaatgctacataaagcatggagacaccctagaagtaccagatgaat gcaaacggagcgccgaggacgactcggagcgggacccctgaacgtgctgaagcccgggcccggatgaccccggccccggcc tcctgttcacaggagctcccgagcgccgaggacaacagcccgatggccagtgacccattaggggtggtcaggggcggtcgagtgaa cacgcacgctggggaacgggcccggaaggctgccgccccttcgccaagttcatctag IL1B Mouse (nucleic acid sequence):

(SEQ ID NO: 303)

Atggcaactgttcctgaactcaactgtgaaatgccacctttttgacagtgatgagaatgacctgttctttgaagttgacgaccccaaaaga tgaagggctgcttccaaacctttgacctgggctgtcctgatgagagcatccagcttcaaatctcgcagcagcacatcaacaagagcttca ggcaggcagtatcactcattgtggctgtggagaagctgtggcagctacctgtgtctttcccgtgaccttccaggatgaggacatgagca -continued ccttcttttccttcatctttgaagaagagcccatcctctgtgactcatgggatgatgatgataacctgctggtgtgt<u>gacgtt</u>ccctactgcgc cactgttcattgccaggactgtccttacgaacctgatccaccaaacacagttccaacttcctgtgaagctaaagaaggagaatgtatt gatagcagctgtggcacctgcacgagagacatactatcagatggactgtgtgaaaataaaccaggaaaaacatgttgccgaatgt gtcagtatgtaattgaatgcagagtagaggccgcaggatggtttagaacattctatggaaagagattccagttccaggaacctggta catacgtgttgggtcaaggaaccaagggcggcgactggaaggtgtccatcaccctggagaacctggatggaaccaaggggggct gtgctgaccaagacaagactggaagtggctggagacatcattgacatcgctcaagctactgagaatcccatcactgtaacggtg gagctgaccctatcatcgccaacccgtacaccatcggcgaggtcaccatcgctgttgttgagatgccaggcttcaacatcaccgtca ttgagttcttcaaactgatcgtgatcgacatcctcggaggaagatctgtaagaatcgccccagacacagcaaacaaaggaatgatc tctggcctctgtggagatcttaaaatgatggaagatacagacttcacttcagatccagaacaactcgctattcagcctaagatcaacc aggagtttgacggttgtccactctatggaaatcctgatgacgttgcatactgcaaaggtcttctggagccgtacaaggacagctgcc gcaacccccatcaacttctactactacaccatctcctgcgccttcgcccgctgtatgggtggagacgagcgagcctcacacgtgctgct tgactacaggggagacgtgcgctgctcccgaaactagaggaacctgcgttttgtctggacatactttctacgatacatttgacaaagc aagatacccaattccagggtccctgcaaggagattcttatggccgccgactgtttctggaacacttgggatgtgaaggtttcacacag gaatgttgactcttacactgaagtagagaaagtacgaatcaggaaacaatcgactgtagtagaactcattgttgatggaaaacaga ttctggttggaggagaagccgtgtccgtcccgtacagctctcagaacacttccatctactggcaagatggtgacatactgactacag ccatcctacctgaagctctggtggtcaagttcaacttcaagcaactgctcgtcgtacatattagagatccattcgatggtaagacttgc ggtatttgcggtaactacaaccaggatttcagtgatgattcttttgatgctgaaggagcctgtgatctgaccccccaaaccaccgggat gcaccgaagaacagaaacctgaagctgaacgactctgcaatagtctcttcgccggtcaaagtgatcttgatcagaaatgtaacgtg tgccacaagcctgaccgtgtcgaacgatgcatgtacgagtattgcctgagggggacaacagggtttctgtgaccacgcatgggagtt caagaaagaatgctacataaagcatggagacaccctagaagtaccagatgaatgcaaactggtgtgt<u>gacgtt</u>cccgttcccatta gacaactgcactacaggctccgagatgaacaacaaaaaagcctcgtgctgtcggacccatatgagctgaaagctctccacctcaatgg acagaatatcaaccaacaagtgatattctccatgagctttgtacaaggagaaccaagcaacgacaaaatacctgtggccttgggcctcaa aggaaagaatctatacctgtcctgtgtaatgaaagacggcacacccaccctgcagctggagagtgtggatcccaagcaatacccaaag aagaagatggaaaaacggtttgtcttcaacaagatagaagtcaagagcaaagtggagtttgagtctgcagagttccccaactggtacatc agcacctcacaagcagagcacaagcctgtcttcctgggaaacaacagtggtcaggacataattgacttcaccatggaatccgtgtcttcc taa IL1B Human (nucleic acid sequence):

(SEQ ID NO: 304)

Atggcagaagtacctgagctcgccagtgaaatgatggcttattacagtggcaatgaggatgacttgttcttttgaagctgatggccctaaa cagatgaagtgctccttccaggacctggacctctgccctctggatgcggcatccagctacgaatctccgaccaccactacagcaagg gcttcaggcaggccgcgtcagttgttgtggccatggacaagctgaggaagatgctggttcctgcccacagaccttccaggagaatga cctgagcaccttctttcccttcatctttgaagaagaacctatcttcttcgacacatgggataacgaggcttatgtgcac<u>gatgca</u>ccttactg cgccactgttcattgccaggactgtccttacgaacctgatccaccaaacacagttccaacttcctgtgaagctaaagaaggagaatg tattgatagcagctgtggcacctgcacgagagacatactatcagatggactgtgtgaaaataaaccaggaaaaacatgttgccga atgtgtcagtatgtaattgaatgcagagtagaggccgcaggatggtttagaacattctatggaaagagattccagttccaggaacct ggtacatacgtgttgggtcaaggaaccaagggcggcgactggaaggtgtccatcaccctggagaacctggatggaaccaaggg ggctgtgctgaccaagacaagactggaagtggctggagacatcattgacatcgctcaagctactgagaatcccatcactgtaaac ggtggagctgaccctatcatcgccaacccgtacaccatcggcgaggtcaccatcgctgttgttgagatgccaggcttcaacatcacc gtcattgagttcttcaaactgatcgtgatcgacatcctcggaggaagatctgtaagaatcgccccagacacagcaaacaaaggaat gatctctggcctctgtggagatcttaaaatgatggaagatacagacttcacttcagatccagaacaactcgctattcagcctaagatc aaccaggagtttgacggttgtccactctatggaaatcctgatgacgttgcatactgcaaaggtcttctggagccgtacaaggacagc tgccgcaacccccatcaacttctactactacaccatctcctgcgccttcgcccgctgtatgggtggagacgagcgagcctcacacgtg -continued ctgcttgactacagggagacgtgcgctgctcccgaaactagaggaacctgcgttttgtctggacatactttctacgatacatttgaca aagcaagataccaattccagggtccctgcaaggagattcttatggccgccgactgtttctggaacacttgggatgtgaaggtttcac acaggaatgttgactcttacactgaagtagagaaagtacgaatcaggaaacaatcgactgtagtagaactcattgttgatggaaaa cagattctggttggaggagaagccgtgtccgtcccgtacagctctcagaacacttccatctactggcaagatggtgacatactgact acagccatcctacctgaagctctggtggtcaagttcaacttcaagcaactgctcgtcgtacatattagagatccattcgatggtaaga cttgcggtattttgcggtaactacaaccaggatttcagtgatgattcttttgatgctgaaggagcctgtgatctgacccccaacccaccg ggatgcaccgaagaacagaaacctgaagctgaacgactcgtcaatagtctcttcgccggtcaaagtgatcttgatcagaaatgta acgtgtgccacaagcctgaccgtgtcgaacgatgcatgtacgagtattgcctgagggggacaacagggtttctgtgaccacgcatgg gagttcaagaaagaatgctacataaagcatggagacaccctagaagtaccagatgaatgcaaaTatgtgcac<u>gatgca</u>cctgta cgatcactgaactgcacgctccgggactcacagcaaaaaagcttggtgatgtctggtccatatgaactgaaagctctccacctccaggg acaggatatggagcaacaagtggtgttctccatgtcctttgtacaaggagaagaaagtaatgacaaaatacctgtggccttgggcctcaa ggaaaagaatctgtacctgtcctgcgtgttgaaagtgataagcccactctacagctggagagtgtagatcccaaaaattacccaaagaa gaagatggaaaagcgatttgtcttcaacaagatagaaatcaataacaagctggaatttgagtctgcccagttccccaactggtacatcag cacctctcaagcagaaaacatgcccgtcttcctgggagggaccaaaggcggccaggatataactgacttcaccatgcaatttgtgtcttc ctaa TNFA Mouse (nucleic acid sequence):

(SEQ ID NO: 305)

Atgagcacagaaagcatgatccgcgacgtggaactggcagaagaggcactcccccaaaagatgggggggcttccagaactccaggc ggtgcctatgtctcagcctcttctcattcctgcttgtggcaggggccaccacgctcttctgtctactgaacttcggggtgatcggtccccaa agggatgagaagttcccaaatggcctccctctcatcagttctatggcccagaccctcaca<u>ctcaga</u>tactgcgccactgttcattgccag gactgtccttacgaacctgatccaccaaacacagttccaacttcctgtgaagctaaagaaggagaatgtattgatagcagctgtggc acctgcacgagacatactatcagatggactgtgtgaaaataaacccaggaaaaacatgttgccgaatgtgtcagtatgtaattga atgcagagtagaggccgcaggatggtttagaacattctatggaaagagattccagttccaggaacctggtacatacgtgttgggtc aaggaaccaagggcggcgactggaaggtgtccatcaccctggagaacctggatgaaccaaggggggctgtgctgaccaagac aagactggaagtggctggagacatcattgacatcgctcaagctactgagaatccatcactgtaaacggtggagctgaccctatca tcgccaacccgtacaccatcggcgaggtcaccatcgctgttgttgagatgccaggcttcaacatcaccgtcattgagttcttcaaact gatcgtgatcgacatcctcggaggaagatctgtaagaatcgccccagacacagcaaacaaaggaatgatctctggcctctgtgga gatcttaaaatgatggaagatacagacttcacttcagatccagaacaactcgctattcagcctaagatcaaccaggagtttgacggt tgtccactctatggaaatcctgatgacgttgcatactgcaaaggtcttctggagccgtacaaggacagctgccgcaacccccatcaac ttctactactacaccatctcctgcgccttcgcccgctgtatgggtggagacgagcagcctcacacgtgctgcttgactacaggag acgtgcgctgctcccgaaactagaggaacctgcgttttgtctggacatactttctacgatacatttgacaaagcaagataccaattcc agggtccctgcaaggagattcttatggccgccgactgtttctggaacacttgggatgtgaaggtttcacacaggaatgttgactcttac actgaagtagagaaagtacgaatcaggaaacaatcgactgtagtagaactcattgttgatggaaaacagattctggttggaggag aagccgtgtccgtcccgtacagctctcagaacacttccatctactggcaagatggtgacatactgactacagccatcctacctgaag ctctggtggtcaagttcaacttcaagcaactgctcgtcgtacatattagagatccattcgatggtaagacttgcggtattttgcggtaact acaaccaggatttcagtgatgattcttttgatgctgaggagcctgtgatctgacccccaacccaccgggatgcaccgaagaacag aaacctgaagctgaacgactctgcaatagtctcttcgccggtcaaagtgatcttgatcagaaatgtaacgtgtgccacaagcctgac cgtgtcgaacgatgcatgtacgagtattgcctgagggacaacagggtttctgtgaccacgcatgggagttcaagaaagaatgcta cataaagcatggagacaccctagaagtaccagatgaatgcaaa<u>ctcaga</u>tcatcttctcaaaattcgagtgacaagcctgtagccca cgtcgtagcaaccaccaagtggaggagcagctggagtggctgagccagcgcgccaacgcccctcctggccaacggcatggatctca aagacaaccaactagtggtgccagccgatgggttgtaccttgtctactcccaggttctcttcaagggacaaggctgccccgactacgtgc -continued tcctcacccacaccgtcagccgatttgctatctcataccaggagaaagtcaacctcctctctgccgtcaagagccctgccccaaggac acccctgaggggctgagctcaaaccctggtatgagcccatatacctgggaggagtcttccagctggagaaggggaccaactcagc gctgaggtcaatctgcccaagtacttagactttgcggagtccgggcaggtctactttggagtcattgctctgtga TNFA Human (nucleic acid sequence):

(SEQ ID NO: 306)

Atgagcactgaaagcatgatccgggacgtggagctggccgaggaggcgctccccaagaagacagggggccccagggctccag gcggtgcttgttcctcagcctcttctccttcctgatcgtggcaggcgccaccacgctcttctgcctgctgcactttggagtgatcggcccc agagggaagagttccccagggacctctctctaatcagccctctggcccaggca*gtcaga*tactgcgccactgttcattgccaggactgt

*ccttacgaacctgatccaccaaacacagttccaacttcctgtgaagctaaagaaggagaatgtattgatagcagctgtggcacctg*

*cacgagagacatactatcagatggactgtgtgaaaataaaccaggaaaaacatgttgccgaatgtgtcagtatgtaattgaatgca*

*gagtagaggccgcaggatggtttagaacattctatgaaagagattccagttccaggaacctggtacatacgtgtttgggtcaagga*

*accaagggcggcgactggaaggtgtccatcaccctggagaacctggatgaaccaaggggggctgtgctgaccaagacaagact*

*ggaagtggctggagacatcattgacatcgctcaagctactgagaatcccatcactgtaaacggtggagctgaccctatcatcgcca*

*acccgtacaccatcggcgaggtcaccatcgctgttgttgagatgccaggcttcaacatcaccgtcattgagttcttcaaactgatcgtg*

*atcgacatcctcggaggaagatctgtaagaatcgccccagacacagcaaacaaaggaatgatctctggcctctgtggagatctta*

*aaatgatggaagatacagacttcacttcagatccagaacaactcgctattcagcctaagatcaaccaggagtttgacggttgtccac*

*tctatggaaatcctgatgacgttgcatactgcaaaggtcttctggagccgtacaaggacagctgccgcaaccccatcaacttctacta*

*ctacaccatctcctgcgccttcgcccgctgtatgggtggagacgagcagcctcacacgtgctgcttgactacagggagacgtgcg*

*ctgctcccgaaactagaggaacctgcgtttttgtctggacatactttctacgatacatttgacaaagcaagataccaattccagggtcc*

*ctgcaaggagattcttatggccgccgactgtttctgaacacttgggatgtgaaggtttcacacaggaatgttgactcttacactgaa*

*gtagagaaagtacgaatcaggaaacaatcgactgtagtagaactcattgttgatggaaaacagattctggttggaggagaagccg*

*tgtccgtcccgtacagctctcagaacacttccatctactggcaagatggtgacatactgactacagccatcctacctgaagctctggt*

*ggtcaagttcaacttcaagcaactgctcgtcgtacatattagagatccattcgatggtaagacttgcggtatttgcggtaactacaacc*

*aggatttcagtgatgattcttttgatgctgaaggagcctgtgatctgaccccaacccaccgggatgcaccgaagaacagaaacct*

*gaagctgaacgactctgcaatagtctcttcgccggtcaaagtgatcttgatcagaaatgtaacgtgtgccacaagcctgaccgtgtc*

*gaacgatgcatgtacgagtattgcctgaggggacaacagggtttctgtgaccacgcatgggagttcaagaaagaatgctacataa*

*agcatggagacaccctagaagtaccagatgaatgcaaa*gtcagatcatcttctcgaaccccgagtgacaagcctgtagcccatgttg tagcaaaccctcaagctgaggggcagctccagtggctgaaccgccgggccaatgccctcctggccaatggcgtggagctgagagat aaccagctggtggtgccatcagagggcctgtacctcatctactcccaggtcctcttcaagggccaaggctgcccctccacccatgtgct cctcacccacaccatcagccgcatcgccgtctcctaccagaccaaggtcaacctcctctctgccatcaagagccctgccagagggag accccagaggggctgaggccaagccctggtatgagcccatctatctgggaggggtcttccagctggagaagggtgaccgactcag cgctgagatcaatcggcccgactatctcgactttgccgagtctgggcaggtctactttgggatcattgccctgtga IFNG Mouse (nucleic acid sequence):

(SEQ ID NO: 307)

Atgaacgctacacactgcatcttggctttgcagctcttcctcatggctgtttctggctgttactgccacggcacagtcattgaaagcctaga aagtctgaataactattttaactcaagtggcatagatgtggaagaaaagagtctcttcttggatatctgaggaactggcaaaaggatggt gacatgaaaatcctgcagagccagattatctctttctacctcagactcttttgaagtcttgaaagacaatcaggccatcagcaacaacataa gcgtcattgaatcacacctgattactaccttcttcagcaacagcaaggcgaaaaaggatgcattcatgagtattgccaagtttgaggtcaa caacccacaggtccagcgccaagcattcaatgagctcatccgagtggtccaccagctgttgccggaatccagcctc*aggaag*tactgc

*gccactgttcattgccaggactgtccttacgaacctgatccaccaaacacagttccaacttcctgtgaagctaaagaaggagaatgt*

*attgatagcagctgtggcacctgcacgagagacatactatcagatggactgtgtgaaaataaaccaggaaaaacatgttgccgaa*

*tgtgtcagtatgtaattgatgcagagtagaggccgcaggatggtttagaacattctatgaaagagattccagttccaggaacctg*

*gtacatacgtgttgggtcaaggaaccaagggcggcgactggaaggtgtccatcaccctggagaacctggatgaaccaagggg*

-continued gcgtgctgaccaagacaagactggaagtggctggagacatcattgacatcgctcaagctactgagaatcccatcactgtaaacg gtggagctgaccctatcatcgccaacccgtacaccatcggcgaggtcaccatcgctgttgttgagatgccaggcttcaacatcaccg tcattgagttcttcaaactgatcgtgatcgacatcctcggaggaagatctgtaagaatcgccccagacacagcaaacaaaggaatg atctctggcctctgtggagatcttaaaatgatggaagatacagacttcacttcagatccagaacaactcgctattcagcctaagatca accaggagtttgacggttgtccactctatggaaatcctgatgacgttgcatactgcaaaggtcttctggagccgtacaaggacagct gccgcaaccccatcaacttctactactacaccatctcctgcgccttcgcccgctgtatgggtggagacgagcgagcctcacacgtgc tgcttgactacagggagacgtgcgctgctcccgaaactagaggaacctgcgttttgtctggacatactttctacgatacatttgacaa agcaagataccaattccagggtccctgcaaggagattcttatggccgccgactgtttctggaacacttgggatgtgaaggtttcaca caggaatgttgactcttacactgaagtagagaaagtacgaatcaggaaacaatcgactgtagtagaactcattgttgatggaaaac agattctggttggaggagaagccgtgtccgtcccgtacagctctcagaacacttccatctactggcaagatggtgacatactgacta cagccatcctacctgaagctctggtggtcaagttcaacttcaagcaactgctcgtcgtacatattagagatccattcgatggtaagact tgcggtatttgcggtaactacaaccaggatttcagtgatgattcttttgatgctgaaggagcctgtgatctgaccccaacccaccgg gatgcaccgaagacagaaacctgaagctgaacgactctgcaatagtctcttgccggtcaaagtgatcttgatcagaaatgtaac gtgtccacaagcctgaccgtgtcgaacgatgcatgtacgagtattgcctgaggggacaacagggtttctgtgaccacgcatggga gttcaagaaagaatgctacataaagcatggagacaccctagaagtaccagatgaatgcaaa<u>cggaaa</u>aggagtcgctgctga IFNG Human (nucleic acid sequence):

(SEQ ID NO: 308)

Atgaaatatacaagttatatcttggcttttcagctctgcatcgttttgggttctcttggctgttactgccaggacccatatgtaaaagaag cagaaaaaccttaagaaatatttttaatgcaggtcattcagatgtagcggataatggaactctttcttaggcattttgaagaattggaaa gaggagagtgacagaaaaataatgcagagccaaattgtctcctttttacttcaaactttttaaaaactttaaagatgaccagagcatc caaagagtgtggagaccatcaaggaagacatgaatgtcaagttttttcaatagcaacaaaagaaacgagatgacttcgaaaaa gctgactaattattcggtaactgacttgaatgtccaacgcaaagcaatacatgaactcatccaagtgatggctgaactgtcgccagc agctaaaacagggaagcgaaaaaggagtcagatgctgtttcgaggt<u>cgaaga</u>tactgcgccactgttcattgccaggactgtccttc acgaacctgatccaccaaacacagttccaacttcctgtgaagctaaagaaggagaatgtattgatagcagctgtggcacctgcac gagagacatactatcagatggactgtgtgaaaataaaccaggaaaaacatgttgccgaatgtgtcagtatgtaattgaatgcaga gtagaggccgcaggatggtttagaacattctatgaaagagattccagttccaggaacctggtacatacgtgtttgggtcaaggaac caagggcggcgactggaaggtgtccatcaccctggagaacctggatggaaccaaggggctgtgctgaccaagacaagactg gaagtggctggagacatcattgacatcgctcaagctactgagaatcccatcactgtaaacggtggagctgaccctatcatcgccaa cccgtacaccatcggcgaggtcaccatcgctgttgttgagatgccaggcttcaacataccgtcattgagttcttcaaactgatcgtga tcgacatcctcggaggaagatctgtaagaatcgccccagacacagcaaacaaaggaatgatctctggcctctgtggagatcttaa aatgatggaagatacagacttcacttcagatccagaacaactcgctattcagcctaagatcaaccaggagtttgacggttgtccact ctatggaaatcctgatgacgttgcatactgcaaaggtcttctggagccgtacaaggacagctgccgcaaccccatcaacttctacta ctacaccatctcctgcgccttcgcccgctgtatgggtggagacgagcgagcctcacacgtgctgcttgactacagggagacgtgcg ctgctcccgaaactagaggaacctgcgttttgtctggacatactttctacgatacatttgacaaagcaagataccaattccagggtcc ctgcaaggagattcttatggccgccgactgtttctggaacacttgggatgtgaaggtttcacacaggaatgttgactcttacactgaa gtagagaaagtacgaatcaggaaacaatcgactgtagtagaactcattgttgatggaaaacagattctggttggaggagaagccg tgtccgtcccgtacagctctcagaacacttccatctactggcaagatggtgacatactgactacagccatcctacctgaagctctggt ggtcaagttcaacttcaagcaactgctcgtcgtacattagagatccattcgatggtaagacttgcggtatttgcggtaactacaacc aggatttcagtgatgattcttttgtgctgaaggagcctgtgatctgaccccaacccaccgggatgcaccgaagaacagaaacct gaagctgaacgactctgcaatagtctcttcgccggtcaaagtgatcttgatcagaaatgtaacgtgtgccacaagcctgaccgtgtc -continued gaacgatgcatgtacgagtattgcctgaggggacaacagggtttctgtaccacgcatgggagttcaagaaagaatgctacataa agcatgagacaccctagaagtaccagatgaatgcaaaggtcgaagagcatcccagtaa Sortilin Mouse (nucleic acid sequence):

(SEQ ID NO: 309)

Atggagcggccccggggagctgcggacggccttttgcgctggcccctcggcctcctcctgctccttcaactgctgcctcctgccgccg tcggccaggaccggctggacgcgccgccgccgccgcgcctcctctgctgcgctgggccggtccggtcggggtgagctgggggct gcgcgccgccgcgcccgggggcccgtcccccgcgctggccgttggcgccgctactgcgccactgttcattgccaggactgtcctt acgaacctgatccaccaaacacagttccaacttcctgtgaagctaaagaaggagaatgtattgatagcagctgtggcacctgcac gagagacatactatcagatggactgtgtgaaaataaaccaggaaaaacatgttgccgaatgtgtcagtatgtaattgaatgcaga gtagaggccgcaggatggtttagaacattctatggaaagagattccagttccaggaacctggtactacgtgtttgggtcaaggaac caagggcggcgactggaaggtgtccatcaccctggagaacctggatggaaccaagggggctgtgctgaccaagacaagactg gaagtggctggagacatcattgacatcgctcaagctactgagaatcccatcactgtaaacggtggagctgaccctatcatcgccaa cccgtacaccatcggcgaggtcaccatcgctgttgttgagatgccaggcttcaacatcaccgtcattgagttcttcaaactgatcgtga tcgacatcctcggaggaagatctgtaagaatcgcccagacacagcaaacaaaggaatgatctctggcctctgtggagatcttaa aatgatggaagatacagacttcacttcagatccagaacaactcgctattcagcctaagatcaaccaggagtttgacgttgtccact ctatggaaatcctgatgacgttgcatactgcaaaggtcttctggagccgtacaaggacagctgccgcaacccccatcaacttctacta ctacaccatctcctgcgccttcgcccgctgtatgggtggagacgagcagcctcacacgtgctgcttgactacagggagacgtgcg ctgctcccgaaactagaggaacctgcgttttgtctggacatactttctacgatacatttgacaaagcaagataccaattccagggtcc ctgcaaggagattcttatggccgccgactgtttctgaacacttgggatgtgaaggtttcacacaggaatgttgactcttacactgaa gtagagaaagtacgaatcaggaaacaatcgactgtagtagaactcattgttgatggaaaacagattctggttggaggagaagccg tgtccgtcccgtacagctctcagaacacttccatctactggcaagatggtgacatactgactacagccatcctacctgaagctctggt ggtcaagttcaacttcagcaactgctcgtcgtacatattagagatccattcgatggtaagacttgcggtatttgcggtaactacaacc aggatttcagtgatgattcttttgatgctgaaggagcctgtgatctgaccccaacccaccgggatgcaccgaagaacagaaacct gaagctgaacgactctgcaatagtctcttcgccggtcaaagtgatcttgatcagaaatgtaacgtgtgccacaagcctgaccgtgtc gaacgatgcatgtacgagtattgcctgaggggacaacagggtttctgtgaccacgcatgggagttcaagaaagaatgctacataa agcatgagacaccctagaagtaccagatgaatgcaaacgccgcggcgcgcccgccgaggaccaagactgcggccgcctccc ggacttcatcgccaagctgaccaacaatacgcaccagcatgtctttgatgacctcagtggctcagtgtccttgtcctgggttggagacag cactggggttattctcgtcctgaccactttccaagtgcctctggtaattgtgagctttggacagtccaagttgtatcgaagtgaggattatgg aaagaactttaaggatattacaaatctcatcaataacaccttcattcggacggaatttggcatggctattggtcctgagaactctggaaagg tgatactaacagcggaggtgtccggggaagccgaggcggaagagtgttcaggtcatcagactttgccaagaactttgtgcaaacaga tctccccttcatcctctgacgcagatgatgtacagccctcagaattctgattacctgttagctctcagcaccgaaaatggcctgtgggtgtc caagaatttggggaaaaatgggaagaaatccacaaagcagtatgtttggccaaatgggaccaaacaacatcatcttctttaccaccca tgtgaatggctcctgcaaagctgatcttggtgccctggaattatggagaacatccgacttgggaaaaaccttcaaaaccattggtgtgaaa atctactcctttggtcttggggggccgtttccttttgcctctgtgatggctgataaggacacaacaagaaggatccatgtgtcaacagacca gggggacacatggagcatggcacaacttccttctgtgggacaggaacagttctactccatcctggcagccaatgaggacatggtcttca tgcatgtagatgaacctggagataccgggtttggcaccaatctttacctctgatgatcgaggcattgtctactccaagtctctggacagacat ctctataccaccacaggcggggagacggactttaccaacgtgacttccctccgtggggtctatataacaagcacgctctcagaagataa ctctattcagagcatgatcactttgaccaggaggacggtggagcacctgcggaagccggagaacagcaagtgcgacgctaccgc aaagaacaagaacgagtgcagccttcatatccatgcttcttatagcatctcccagaagctaaacgttccaatggccccactttccgagccc aatgctgtgggcatagtcatcgctcacggtagtgtgggagatgccatctcggtgatggtcccagatgtgtacatctcagatgatggggt tactcctgggcgaagatgctagaaggaccacattactataccatcctggactctggaggcatcattgtggccattgagcacagcaaccgt -continued cctatcaatgtgattaagttctccacagatgaaggccagtgctggcagagctatgtgttcacacaggagcccatctacttcactgggcttg cttccgagcctggagccaggtccatgaacatcagcatctggggattcacagagtctttcattacccgccagtgggtctcctacacagtcg atttcaaagacatccttgagcggaattgtgaagaggatgactataccacgtggctggcacactccacagaccctggagattacaaagac ggctgcattttgggctataaagaacagttcctacggctacggaagtcatccgtctgtcagaatggtcgagactatgttgtggccaagcag ccatccgtctgtccgtgttccctggaggacttcctctgtgactttggctacttccgtccggagaacgcctcagagtgcgtggagcagcctg aactgaaggggcatgagttagagttctgtctgtacgcaaggaggagcacctgacaacaaatggggtaccggaaaatcccaggagaca aatgccaaggtgggatgaatcccgccagagaagtaaaagacttgaaaaagaaatgcacaagcaacttcttgaaccccacaaagcagg actcccgcccacagggacacagcttgtcccagaatccagctccgcctcctcttggatacactgaaaacacacacttcctatctcctaccc agaagcagaattccaagtcaaattctgtccctattatcctggccatcgtgggactgatgcttgtcacagtcgtagcaggagtcctcattgtg aagaaatatgtctgtggcggaaggttcctggtgcaccggtactcggtgctacagcagcacgcagaggctgacggcgtagaggctttgg attcaacctcccacgctaaaagcggatatcacgacgactcagatgaggacctcctggaatag Sortilin Human (nucleic acid sequence):

(SEQ ID NO: 310)

Atggagcggccctggggagctgcggacggcctctcgcgctggccccatggcctcggcctcctcctcctcctgcagctgctgccgcc gtcgaccctcagccaggaccggctggacgcgccgccgccgcccgctgcgccgctgccgcgctggtctggcccatcggggtgagc tggggggctgcgggcggccgcagccgggggcgcgtttccccgcggcggccgttgg*cgtcgc*tactgcgccactgttcattgccagg actgtccttacgaacctgatccaccaaacacagttccaacttcctgtgaagctaaagaaggagaatgtattgatagcagctgtggca cctgcacgagagacatactatcagatggactgtgtgaaaataaaccaggaaaaacatgttgccgaatgtgtcagtatgtaattgaa tgcagagtagaggccgcaggatggtttagaacattctatggaaagagattccagttccaggaacctggtacatacgtgttgggtca aggaaccaagggcggcgactggaaggtgtccatcaccctggagaacctggatggaaccaagggggctgtgctgaccaagaca agactggaagtggctggagacatcattgacatcgctcaagctactgagaatcccatcactgtaaacggtggagctgaccctatcat cgccaacccgtacaccatcggcgaggtcaccatcgctgttgttgagatgccaggcttcaacatcaccgtcattgagttcttcaaactg atcgtgatcgacatcctcggaggaagatctgtaagaatcgccccagacacagcaaacaaaggaatgatctctggcctctgtggag atcttaaaatgatggaagatacagacttcacttcagatccagaacaactcgctattcagcctaagatcaaccaggagtttgacggtt gtccactctatggaaatcctgatgacgttgcatactgcaaaggtcttctggagccgtacaaggacagctgccgcaaccccatcaact tctactactacaccatctcctgcgccttcgcccgctgtatgggtggagacgagcgagcctcacacgtgctgcttgactacaggagga cgtgcgctgctcccgaaactagaggaacctgcgttttgtctggacatactttctacgatacatttgacaaagcaagataccaattcca gggtccctgcaaggagattcttatggccgccgactgtttctggaacacttgggatgtgaaggtttcacacaggaatgttgactcttaca ctgaagtagagaaagtacgaatcaggaaacaatcgactgtagtagaactcattgttgatggaaaacagattctggttggaggaga agccgtgtccgtcccgtacagctctcagaacacttccatctactggcaagatggtgacatactgactacagccatcctacctgaagct ctggtggtcaagttcaacttcaagcaactgctcgtcgtacatattagagatccattcgatggtaagacttgcggtatttgcggtaacta caaccaggatttcagtgatgattcttttgatgctgaaggagcctgtgatctgaccccaacccaccgggatgcaccgaagaacaga aacctgaagctgaacgactctgcaatagtctcttcgccggtcaaagtgatcttgatcagaaatgtaacgtgtgccacaagcctgacc gtgtcgaacgatgcatgtacgagtattgcctgagggacaacagggtttctgtgaccacgcatgggagttcaagaaagaatgctac ataaagcatggagacacccctagaagtaccagatgaatgcaaa*cgtcgc*agcgcgccgggcgaggacgaggagtgcggccggg tccgggacttcgtcgccaagctggccaacaacacgcaccagcatgtgtttgatgatctcagaggctcagtatccttgtcctgggttggag atagcactggggtcattctagtcttgactaccttccatgtaccactggtaattatgacttttggacagtccaagctatatcgaagtgaggatta tgggaagaacttttaaggatattacagatctcatcaataacacctttattcggactgaatttggcatggctattggtcctgagaactctggaaa ggtggtgttaacagcagaggtgtctggaggaagtcgtggaggaagaatctttagatcatcagattttgcgaagaattttgtgcaaacag at ctccctttttcatcctctcactcagatgatgtatagccctcagaattctgattatcttttagctctcagcactgaaaatggcctgtgggtgtccaa gaattttgggggaaaatgggaagaaatccacaaagcagtatgtttggccaaatggggatcagacaacaccatcttctttacaacctatgc aaatggctcctgcaaagctgaccttggggctctggaattatggagaacttcagacttgggaaaaagcttcaaaactattggtgtgaaaatc tactcatttggtcttgggggacgtttcctttttgcctctgtgatggctgataaggatacaacaagaaggatccacgtttcaacagatcaagg ggacacatggagcatggcccagctcccctccgtgggacaggaacagttctattctattctggcagcaaatgatgacatggtattcatgca tgtagatgaacctggagacactgggtttggcacaatctttacctcagatgatcgaggcattgtctattccaagtctttggaccgacatctcta cactaccacaggcggagagacggactttaccaacgtgacctcctccgcggcgtctcataacaagcgtgctctccgaagataattcta tccagaccatgatcacttttgaccaaggaggaaggtggacgcacctgaggaagcctgaaaacagtgaatgtgatgctacagcaaaaaa caagaatgagtgcagccttcatattcatgcttcctacagcatctcccagaaactgaatgttccaatggcccactctcagagccgaatgcc gtaggcattgtcattgctcatggtagcgtgggggatgccatctcagtgatggttccagatgtgtacatctcagatgatgggggttactcctg gacaaagatgctggaaggaccccactattacaccatcctggattctggaggcatcattgtggccattgagcacagcagccgtcctatca atgtgattaagttctccacagacgaaggtcaatgctggcaaacctacacgttcaccagggaccccatctatttcactggcctagcttcaga acctggagctaggtccatgaatatcagcatttggggcttcacagaatcttttcctgaccagccagtgggtctcctacaccattgattttaaag atatccttgaaaggaactgtgaagagaaggactataccatatggctggcacactccagacccctgaagattatgaagatggctgcatttt gggctacaaagaacagtttctgcggctacgcaagtcatccgtgtgtcagaatggtcgagactatgttgtgaccaagcagccctccatctg cctctgttcctggaggactttctctgtgattttggctactaccgtccagaaaatgactccaagtgtgtggaacagccagaactgaagggc cacgacctggagttttgtctgtacggaagagaagaacacctaacaacaaatgggtaccgaaaattccagggggacaaatgccagggt ggggtaaatccagttcgagaagtaaaagacttgaaaaagaaatgcacaagcaacttttttgagtccggaaaaacagaattccaagtcaaa ttctgttccaattatcctggccatcgtgggattgatgctggtcacagtcgtagcaggagtgctcattgtgaagaaatatgtctgtggggaa ggttcctggtgcatcgatactctgtgctgcagcagcatgcagaggccaatggtgtggatggtgtggatgctttggacacagcctcccaca ctaataaaagtggttatcatgatgactcagatgaggacctcttggaatag Neuropeptide W Mouse (nucleic acid sequence):

(SEQ ID NO: 311)

*Ctggcgtctaacagagaagtgcggggccctgggcccgggactcccaggaacggccctgctgcccctgctgctgcttctgctcttg*

*ctaccgctgcccgccagcgcctggtataagcacgtggcgagtccccgctatcacacagtgggtcgtgcctccgggctgctcatgggg*

*ctgcgccgctcgccctaccagtgg<u>cgccgt</u>tactgcgccactgttcattgccaggactgtccttacgaacctgatccaccaaacaca*

*gttccaacttcctgtgaagctaaagaaggagaatgtattgatagcagctgtggcacctgcacgagagacatactatcagatggact*

*gtgtgaaaataaaccaggaaaaacatgttgccgaatgtgtcagtatgtaattgaatgcagagtagaggccgcaggatggtttaga*

*acattctatggaaagagattccagttccaggaacctggtacatacgtgttgggtcaaggaaccaagggcggcgactggaaggtgt*

*ccatcaccctggagaacctggatggaaccaagggggctgtgctgaccaagacaagactggaagtggctggagacatcattgac*

*atcgctcaagctactgagaatccatcactgtaaacggtggagctgaccctatcatcgccaacccgtacaccatcggcgaggtcac*

*catcgctgttgttgagatgccaggcttcaacatcaccgtcattgagttcttcaaactgatcgtgatcgacatcctcggaggaagatctg*

*taagaatcgccccagacacagcaaacaaggaatgatctctggcctctgtggagatcttaaaatgatggaagatacagacttcac*

*ttcagatccagaacaactcgctattcagcctaagatcaaccaggagtttgacggttgtccactctatggaaatcctgatgacgttgca*

*tactgcaaaggtcttctggagccgtacaaggacagctgccgcaacccccatcaacttctactactacaccatctcctgcgccttcgccc*

*gctgtatgggtggagacgagcgagcctcacacgtgctgcttgactacaggagacgtgcgctgctcccgaaactagaggaacct*

*gcgttttgtctggacatactttctacgatacatttgacaaagcaagataccaattccagggtccctgcaaggagattcttatggccgcc*

*gactgtttctggaacacttgggatgtgaaggtttcacacaggaatgttgactcttacactgaagtagagaaagtacgaatcaggaaa*

*caatcgactgtagtagaactcattgttgatgaaaacagattctggttggaggagaagccgtgtccgtcccgtacagctctcagaac*

*acttccatctactggcaagatggtgacatactgactacagccatcctacctgaagctctggtggtcaagttcaacttcaagcaactgc*

*tcgtcgtacatattagagatccattcgatggtaagacttgcggtatttgcggtaactacaaccaggatttcagtgatgattcttttgatgc*

*tgaaggagcctgtgatctgaccccaacccaccgggatgcaccgaagaacagaaacctgaagctgaacgactctgcaatagtct*

*cttcgccggtcaaagtgatcttgatcagaaatgtaacgtgtgccacaagcctgaccgtgtcgaacgatgcatgtacgagtattgcct*

*gaggggacaacaggggtttctgtgaccacgcatgggagttcaagaaagaatgctacataaagcatggagacaccctagaagtac* cagatgaatgcaaacgccgtgccctgggcggggctgctgaccccctctcccggctcccaggaccggtcgcccgcggcgctctcct gcttccttcctcagggcaggagctgtgggaggtacgaagcaggagctcacctgcagggcttcccgtccatgcaccctggagtccgcg ggacctggagggagtccgccaaccggagcagtcgctaagccttcactcctggatctcagaggagcccgctgctagagccttcggaga gacgcttcgtgcccagccatggttcctgcagcaagtcatctttgccgatcctgtcaggcccaagaaccgatggcgcccccatgcttga Neuropeptide W Human (nucleotide acid sequence):

(SEQ ID NO: 312)

Ctggcgtggcgcccaggggagcggggggctcccgcgagccggccgcggctggcactgctgctgcttctgctcctgctgccgctgc cctccggcgcgtggtacaagcacgtggcgagtccccgctaccacacggtgggccgcgccgctggcctgctcatggggctgcgtcgc tcacctatctgtggcgccgctactgcgccactgttcattgccaggactgtccttacgaacctgatccaccaaacacagttccaacttc ctgtgaagctaaagaaggagaatgtattgatagcagctgtggcacctgcacgagagacatactatcagatggactgtgtgaaaat aaaccaggaaaaacatgttgccgaatgtgtcagtatgtaattgaatgcagagtagaggccgcaggatggtttagaacattctatgg aaagagattccagttccaggaacctggtacatacgtgtttgggtcaaggaaccaagggcggcgactggaaggtgtccatcaccctg gagaacctggatggaaccaagggggctgtgctgaccaagacaagactggaagtggctggagacatcattgacatcgctcaagct actgagaatcccatcactgtaaacggtggagctgaccctatcatcgccaacccgtacaccatcggcgaggtcaccatcgctgttgtt gagatgccaggcttcaacatcaccgtcattgagttcttcaaactgatcgtgatcgacatcctcggaggaagatctgtaagaatcgcc ccagacacagcaaacaaaggaatgatctctggcctctgtggagatcttaaaatgatggaagatacagacttcacttcagatccag aacaactcgctattcagcctaagatcaaccaggagtttgacggttgtccactctatggaaatcctgatgacgttgcatactgcaaag gtcttctggagccgtacaaggacagctgccgcaaccccatcaacttctactactacaccatctctgcgccttcgcccgctgtatggg tggagacgagcgagcctcacacgtgctgcttgactacagggagacgtgcgctgctcccgaaactagaggaacctgcgttttgtctg gacatactttctacgatacatttgacaaagcaagataccaattccagggtccctgcaaggagattcttatgccgccgactgtttctg gaacacttgggatgtgaaggttttcacacaggaatgttgactcttacactgaagtagagaaagtacgaatcaggaaacaatcgact gtagtagaactcattgttgatggaaaacagattctggttggaggagaagccgtgtccgtcccgtacagctctcagaacacttccatct actggcaagatggtgacatactgactacagccatcctacctgaagctctggtggtcaagttcaacttcaagcaactgctcgtcgtac atattagagatccattcgatggtaagacttgcggtatttgcggtaactacaaccaggatttcagtgatgattcttttgatgctgaaggag cctgtgatctgaccccaacccaccgggatgcaccgaagaacagaaacctgaagctgaacgactctgcaatagtctcttcgccgg tcaaagtgatcttgatcagaaatgtaacgtgtgccacaagcctgaccgtgtcgaacgatgcatgtacgagtattgcctgagggggac aacagggtttctgtgaccacgcatgggagttcaagaaagaatgctacataaagcatggagacaccctagaagtaccagatgaat gcaaacgccgcgcgctgcgcgcggccgccgggcccctggccagggacacccctctcccccgaacccgcagcccgcgaggctcctc tcctgctgccctcgtgggttcaggagctgtgggagacgcgacgcaggagctcccaggcagggatcccgtccgtgcgccccggagc ccgcgcgccccagagcctgcgctggaaccggagtccctggacttcagcggagctggccagagacttcggagagacgtctcccgccc agcggtggaccccgcagcaaaccgccttggcctgccctgcctggccccccggaccgttctga CART Mouse (nucleic acid sequence):

(SEQ ID NO: 313)

Atggagagctcccgcctgcggctgctaccccctcctgggcgccgccctgctgctactgctacctttgctgggtgcccgtgcccaggagg acgccgagctgcagccccgagccctggacatctactctgccgtggatgatgcgtcccacgagaaggagctgatcgaagcgttgcaag aagtcctgaagaagctcaagagtaaacgctactgcgccactgttcattgccaggactgtccttacgaacctgatccaccaaacacagt tccaacttcctgtgaagctaaagaaggagaatgtattgatagcagctgtggcacctgcacgagagacatactatcagatggactgt gtgaaaataaaccaggaaaaacatgttgccgaatgtgtcagtatgtaattgaatgcagagtagaggccgcaggatggtttagaac attctatggaaagagattccagttccaggaacctggtacatacgtgtttgggtcaaggaaccaagggcggcgactggaaggtgtcc atcaccctggagaacctggatggaaccaagggggctgtgctgaccaagacaagactggaagtggctggagacatcattgacatc gctcaagctactgagaatcccatcactgtaaacggtggagctgaccctatcatcgccaacccgtacaccatcggcgaggtcaccat cgctgttgttgagatgccaggcttcaacatcaccgtcattgagttcttcaaactgatcgtgatcgacatcctcggaggaagatctgtaa gaatcgccccagacacagcaaacaaaggaatgatctctggcctctgtggagatcttaaaatgatggaagatacagacttcacttca -continued

```
gatccagaacaactcgctattcagcctaagatcaaccaggagtttgacggttgtccactctatggaaatcctgatgacgttgcatact
gcaaaggtcttctggagccgtacaaggacagctgccgcaaccccatcaacttctactactacaccatctcctgcgccttcgcccgct
gtatgggtggagacgagcgagcctcacacgtgctgcttgactacagggagacgtgcgctgctcccgaaactagaggaacctgcg
ttttgtctggacatactttctaacgatacatttgacaaagcaagataccaattccagggtccctgcaaggagattcttatggccgccgac
tgtttctggaacactttgggatgtgaaggtttcacacaggaatgttgactcttacactgaagtagagaaagtacgaatcaggaaacaa
tcgactgtagtagaactcattgttgatggaaaacagattctggttggaggagaagccgtgtccgtcccgtacagctctcagaacactt
ccatctactggcaagatggtgacatactgactacagccatcctacctgaagctctggtggtcaagttcaacttcaagcaactgctcgt
cgtacatattagagatccattcgatggtaagacttgcggtatttgcggtaactacaaccaggaatttcagtgatgattcttttgatgctga
aggagcctgtgatctgaccccaacccaccgggatgcaccgaagaacagaaacctgaagctgaacgactctgcaatagtctcttc
gccggtcaaagtgatcttgatcagaaatgtaacgtgtgccacaagcctgaccgtgtcgaacgatgcatgtacgagtattgcctgag
gggacaacagggtttctgtgaccacgcatgggagttcaagaaagaatgctacataaagcatggagacaccctagaagtaccag
atgaatgcaaaaaacgcattccgatctacgagaagaagtacggccaagtccccatgtgtgacgctggagagcagtgcgcagtgagg
aaggggccaggatcgggaagctgtgtgactgtcccgaggaacttcctgcaattctttcctcttgaagtgcttgtga
```

CART Human (nucleic acid sequence): (SEQ ID NO: 314)

```
Atggagagctcccgcgtgaggctgctgccctcctgggcgccgccctgctgctgatgctacctctgttgggtacccgtgcccaggag
gacgccgagctccagccccgagccctggacatctactctgccgtggatgatgcctcccacgagaaggagctgatcgaagcgctgcaa
gaagtcttgaagaagctcaagagtaaacgttactgcgccactgttcattgccaggactgtccttacgaacctgatccaccaaacacag
ttccaacttcctgtgaagctaaagaaggagaatgtattgatagcagctgtggcacctgcacgagagacatactatcagatggactgt
gtgaaaataaaccaggaaaaacatgttgccgaatgtgtcagtatgtaattgaatgcagagtagaggccgcaggatggtttagaac
attctatggaaagagattccagttccaggaacctggtacatacgtgttgggtcaaggaaccaaggggcggcgactggaaggtgtcc
atcaccctggagaacctggatggaaccaagggggctgtgctgaccaagacaagactggaagtggctggagacatcattgacatc
gctcaagctactgagaatcccatcactgtaaacggtggagctgaccctatcatcgccaacccgtacaccatcggcgaggtcaccat
cgctgttgttgagatgccaggcttcaacatcaccgtcattgagttcttcaaactgatcgtgatcgacatcctcggaggaagatctgtaa
gaatcgccccagacacagcaaacaaggaatgatctctggcctctgtggagatcttaaaatgatggaagatacagacttcacttca
gatccagaacaactcgctattcagcctaagatcaaccaggagtttgacggttgtccactctatggaaatcctgatgacgttgcatact
gcaaaggtcttctggagccgtacaaggacagctgccgcaaccccatcaacttctactactacaccatctcctgcgccttcgcccgct
gtatgggtggagacgagcgagcctcacacgtgctgcttgactacagggagacgtgcgctgctcccgaaactagaggaacctgcg
ttttgtctggacatactttctacgatacatttgacaaagcaagataccaattccagggtccctgcaaggagattcttatggccgccgac
tgtttctggaacactttgggatgtgaaggtttcacacaggaatgttgactcttacactgaagtagagaaagtacgaatcaggaaacaa
tcgactgtagtagaactcattgttgatggaaaacagattctggttggaggagaagccgtgtccgtcccgtacagctctcagaacactt
ccatctactggcaagatggtgacatactgactacagccatcctacctgaagctctggtggtcaagttcaacttcaagcaactgctcgt
cgtacatattagagatccattcgatggtaagacttgcggtatttgcggtaactacaaccaggatttcagtgatgattcttttgatgctga
aggagcctgtgatctgaccccaacccaccgggatgcaccgaagacagaaacctgaagctgaacgactctgcaatagtctcttc
gccggtcaaagtgatcttgatcagaaatgtaacgtgtgccacaagcctgaccgtgtcgaacgatgcatgtacgagtattgcctgag
gggacaacagggtttctgtgaccacgcatgggagttcaagaaagaatgctacataaagcatggagacaccctagaagtaccag
atgaatgcaaaaaacgtgttcccatctatgagaagaagtatggccaagtccccatgtgtgacgccggtgagcagtgtgcagtgaggaa
aggggcaaggatcgggaagctgtgtgactgtcccgaggaacttcctgcaattcttcctcctgaagtgcttatga
```

TGFB1 Mouse (nucleic acid sequence): (SEQ ID NO: 315)

```
Atgccgccctcggggctgcggctactgccgcttctgctcccactcccgtggcttctagtgctgacgcccggggaggcagccgcggga
ctctccacctgcaagaccatcgacatggagctggtgaaacggaagcgcatcgaagccatccgtggccagatcctgtccaaactaagg
```

-continued

```
ctcgccagtcccccaagccaggggaggtaccgcccggcccgctgcccgaggcggtgctcgctttgtacaacagcacccgcgacc
gggtggcaggcgagagcgccgacccagagccggagcccgaagcggactactatgctaaagaggtcacccgcgtgctaatggtgga
ccgcaacaacgccatctatgagaaaaccaaagacatctcacacagtatatatatgttcttcaatacgtcagacattcgggaagcagtgcc
cgaaccccattgctgtcccgtgcagagctgcgcttgcagagattaaaatcaagtgtggagcaacatgtggaactctaccagaaatata
gcaacaattcctggcgttaccttggtaaccggctgctgaccccactgatacgcctgagtggctgtcttttgacgtcactggagttgtacg
gcagtggctgaaccaaggagacggaatacagggctttcgattcagcgctcactgctcttgtgacagcaaagataacaaactccacgtg
gaaatcaacgggatcagccccaaacgtcggggcgacctgggcaccatccatgacatgaaccggcccttcctgctcctcatggccacc
cccctggaaagggcccagcacctgcacagctcacggcaccgggagatactgcgccactgttcattgccaggactgtccttacgaacct
gatccaccaaacacagttccaacttcctgtgaagctaaagaaggagaatgtattgatagcagctgtggcacctgcacgagagaca
tactatcagatggactgtgtgaaaataaaccaggaaaaacatgttgccgaatgtgtcagtatgtaattgaatgcagagtagaggcc
gcaggatggtttagaacattctatggaaagagattccagttccaggaacctggtacatacgtgttgggtcaaggaaccaagggcg
gcgactggaaggtgtccatcaccctggagaacctggatggaaccaaggggctgtgctgaccaagacaagactggaagtggct
ggagacatcattgacatcgctcaagctactgagaatcccatcactgtaaacggtggagctgaccctatcatcgccaacccgtacac
catcggcgaggtcaccatcgctgttgttgagatgccaggcttcaacatcaccgtcattgagttcttcaaactgatcgtgatcgacatcc
tcggaggaagatctgtaagaatcgccccagacacagcaaacaaaggaatgatctctggcctctgtggagatcttaaaatgatgga
agatacagacttcacttcagatccagaacaactcgctattcagcctaagatcaaccaggagtttgacggttgtccactctatggaaat
cctgatgacgttgcatactgcaaaggtcttctggagccgtacaaggacagctgccgcaaccccatcaacttctactactacaccatct
cctgcgccttcgcccgctgtatgggtggagacgagcgagcctcacacgtgctgcttgactacagggagacgtgcgctgctcccgaa
actagaggaacctgcgtttttgtctggacatactttctacgatacatttgacaaagcaagataccaattccaggtccctgcaaggag
attcttatggccgccgactgtttctggaacacttgggatgtgaaggtttcacacaggaatgttgactcttacactgaagtagagaaagt
acgaatcaggaaacaatcgactgtagtagaactcattgttgatggaaaacagattctggttggaggagaagccgtgtccgtcccgt
acagctctcagaacacttccatctactggcaagatggtgacatactgactacagccatcctacctgaagctctggtggtcaagttcaa
cttcaagcaactgctcgtcgtacatattagagatccattcgatggtaagacttgcggtatttgcggtaactacaaccaggatttcagtg
atgattcttttgatgctgaaggagcctgtgatctgaccccaacccaccgggatgcaccgaagaacagaaacctgaagctgaacg
actctgcaatagtctcttcgccggtcaaagtgatcttgatcagaaatgtaacgtgtgccacaagcctgaccgtgtcgaacgatgcatg
tacgagtattgcctgaggggacaacagggtttctgtgaccacgcatgggagttcaagaaagaatgctacataaagcatggagaca
ccctagaagtaccagatgaatgcaaacggagagccctggataccaactattgcttcagctccacagagaagaactgctgtgtgcggc
agctgtacattgactttaggaaggacctgggttggaagtggatccacgagcccaagggctaccatgccaacttctgtctgggaccctgc
ccctatatttggagcctggacacacagtacagcaaggtccttgccctctacaaccaacacaacccgggcgcttcggcgtcaccgtgctg
cgtgccgcaggctttggagccactgccatcgtctactacgtgggtcgcaagcccaaggtggagcagttgtccaacatgattgtgcgct
cctgcaagtgcagctga
```

TGFB1 Human (nucleic acid sequence):

(SEQ ID NO: 316)

```
Atgccgccctccgggctgcggctgctgccgctgctgctaccgctgctgtggctactggtgctgacgcctggccggcggccgcggg
actatccacctgcaagactatcgacatggagctggtgaagcggaagcgcatcgaggccatccgcggccagatcctgtccaagctgcg
gctcgccagccccccgagccaggggaggtccgcccggcccgctgcccgaggccgtgctcgccctgtacaacagcacccgcga
ccgggtggccggggagagtgcagaaccggagcccgagcctgaggccgactactacgccaaggaggtcacccgcgtgctaatggtg
gaaacccacaacgaaatctatgacaagttcaagcagagtacacacagcatatatatgttcttcaacacatcagagctccgagaagcggt
acctgaaccgtgttgctctccccgggcagagctgcgtctgctgaggctcaagttaaaagtggagcagcacgtggagctgtaccagaaa
tacagcaacaattcctggcgatacctcagcaaccggctgctggcacccagcgactcgccagagtggttatcttttgatgtcaccggagtt
gtgcggcagtggttgagccgtggagggggaaattgagggctttcgccttagcgcccactgctcctgtgacagcagggataacacactgc
aagtggacatcaacgggttcactaccggccgccgaggtgacctggccaccattcatggcatgaaccggcctttcctgcttctcatggcc
``` accccgctggagagggcccagcatctgcaaagctcccggcac<u>cgccga</u>tactgcgccactgttcattgccaggactgtccttacgaa
cctgatccaccaaacacagttccaacttcctgtgaagctaaagaaggagaatgtattgatagcagctgtggcacctgcacgagag
acatactatcagatggactgtgtgaaaataaaccaggaaaaacatgttgccgaatgtgtcagtatgtaattgaatgcagagtagag
gccgcaggatggtttagaacattctatggaaagagattccagttccaggaacctggtacatacgtgtttgggtcaaggaaccaaggg
cggcgactggaaggtgtccatcaccctggagaacctggatggaaccaaggggggctgtgctgaccaagacaagactggaagtgg
ctggagacatcattgacatcgctcaagctactgagaatcccatcactgtaaacggtggagctgaccctatcatcgccaacccgtac
accatcggcgaggtcaccatcgctgttgttgagatgccaggcttcaacatcaccgtcattgagttcttcaaactgatcgtgatcgacat
cctcggaggaagatctgtaagaatcgcccagacacagcaaacaaggaatgatctctggcctctgtggagatcttaaaatgatg
gaagatacagacttcacttcagatccagaacaactcgctattcagcctaagatcaaccaggagtttgacggttgtccactctatgga
aatcctgatgacgttgcatactgcaaaggtcttctggagccgtacaaggacagctgccgcaacccccatcaacttctactactacacc
atctcctgcgccttcgcccgctgtatgggtggagacgagcgagcctcacacgtgctgcttgactacagggagacgtgcgctgctccc
gaaactagaggaacctgcgttttgtctggacatactttctacgatacatttgacaaagcaagataccaattccagggtccctgcaag
gagattcttatggccgccgactgtttctggaacacttgggatgtgaaggtttcacacaggaatgttgactcttacactgaagtagaga
aagtacgaatcaggaaacaatcgactgtagtagaactcattgttgatggaaaacagattctggttggaggagaagccgtgtccgtc
ccgtacagctctcagaacacttccatctactggcaagatggtgacatactgactacagccatcctacctgaagctctggtggtcaagt
tcaacttcaagcaactgctcgtcgtacatattagagatccattcgatggtaagacttgcggtatttgcggtaactacaaccaggatttc
agtgatgattcttttgatgctgaaggagcctgtgatctgacccccaacccaccgggatgcaccgaagaacagaaacctgaagctg
aacgactctgcaatagtctcttcgccggtcaaagtgatcttgatcagaaatgtaacgtgtgccacaagcctgaccgtgtcgaacgat
gcatgtacgagtattgcctgaggggacaacagggtttctgtgaccacgcatgggagttcaagaagaatgctacataaagcatgg
agacaccctagaagtaccagatgaatgcaaa<u>cgccga</u>gccctggacaccaactattgcttcagctccacggagaagaactgctgcg
tgcggcagctgtacattgacttccgcaaggacctcggctggaagtggatccacgagcccaagggctaccatgccaacttctgcctcgg
gccctgcccctacatttggagcctggacacgcagtacagcaaggtcctggccctgtacaaccagcataacccgggcgcctcggcggc
gccgtgctgcgtgccgcaggcgctggagccgctgcccatcgtgtactacgtgggccgcaagcccaaggtggagcagctgtccaaca
tgatcgtgcgctcctgcaagtgcagctga TGFB2 Mouse (nucleic acid sequence):

(SEQ ID NO: 317)

Atgcactactgtgtgctgagcaccttttttgctcctgcatctggtcccggtggcgctcagtctgtctacctgcagcaccctcgacatggatc
agtttatgcgcaagaggatcgaggccatccgcgggcagatcctgagcaagctgaagctcaccagccccccggaagactatccggag
ccggatgaggtccccccggaggtgatttccatctacaacagtaccagggacttactgcaggagaaggcaagccggagggcagccgc
ctgcgagcgcgagcggagcgacgaggagtactacgccaaggaggtttataaaatcgacatgccgtccccacctcccctccgaaaatgc
catcccgcccactttctacagaccctacttcagaatcgtccgctttgatgtctcaacaatggagaaaaatgcttcgaatctggtgaaggca
gagttcagggtcttccgcttgcaaaacccaaagccagagtggccgagcagcggattgaactgtatcagatccttaaatccaaagactt
aacatctcccacccagcgctacatcgatagcaaggttgtgaaaaccagagcggagggtgaatggctctccttcgacgtgacagacgct
gtgcaggagtggcttcaccacaaagacaggaacctggggtttaaaataagtttacactgcccctgctgtaccttcgtgccgtctaataatt
acatcatcccgaataaaagcgaagagctcgaggcgagatttgcaggtattgatggcacctctacatatgccagtggtgatcagaaaact
ataaagtccactaggaaaaaaaaccagtgggaagaccccacatctcctgctaatgttgttgccctcctacagactggagtcacaacagtcc
agc<u>cggcgg</u>tactgcgccactgttcattgccaggactgtccttacgaacctgatccaccaaacacagttccaacttcctgtgaagcta
agaaggagaatgtattgatagcagctgtggcacctgcacgagagacatactatcagatggactgtgtgaaaataaaccaggaa
aaacatgttgccgaatgtgtcagtatgtaattgaatgcagagtagaggccgcaggatggtttagaacattctatggaaagagattcc
agttccaggaacctggtacatacgtgtttgggtcaaggaaccaagggcggcgactggaaggtgtccatcaccctggagaacctgg
atggaaccaaggggggctgtgctgaccaagacaagactggaagtggctggagacatcattgacatcgctcaagctactgagaatc -continued ccatcactgtaaacggtggagctgaccctatcatcgccaacccgtacaccatcggcgaggtcaccatcgctgttgttgagatgccag gcttcaacatcaccgtcattgagttcttcaaactgatcgtgatcgacatcctcggaggaagatctgtaagaatcgcccagacacag caaacaaaggaatgatctctggcctctgtggagatcttaaaatgatggaagatacagacttcacttcagatccagaacaactcgct attcagcctaagatcaaccaggagtttgacgttgtccactctatggaaatcctgatgacgttgcatactgcaaaggtcttctggagc cgtacaaggacagctgccgcaaccccatcaacttctactactacaccatctcctgcgccttcgcccgctgtatgggtggagacgagc gagcctcacacgtgctgcttgactacagggagacgtgcgctgctcccgaaactagaggaacctgcgttttgtctggacatactttcta cgatacatttgacaaagcaagataccaattccagggtccctgcaaggagattcttatggccgccgactgtttctggaacacttggga tgtgaaggtttcacacaggaatgttgactcttacactgaagtagagaaagtacgaatcaggaaacaatcgactgtagtagaactca ttgttgatggaaaacagattctggttggaggagaagccgtgtccgtcccgtacagctctcagaacacttccatctactggcaagatg gtgacatactgactacagccatcctacctgaagctctggtggtcaagttcaacttcaagcaactgctcgtcgtacatattagagatcc attcgatggtaagacttgcggtatttgcggtaactacaaccaggatttcagtgatgattcttttgatgctgaaggagcctgtgatctgac ccccaacccaccgggatgcaccgaagaacagaaacctgaagctgaacgactctgcaatagtctcttcgccggtcaaagtgatctt gatcagaaatgtaacgtgtgccacaagcctgaccgtgtcgaacgatgcatgtacgagtattgcctgaggggcaacagggtttctg tgaccacgcatgggagttcaagaaagaatgctacataaagcatggagacaccctagaagtaccagatgaatgcaaa*cggcgga* agaagcgcgctttggatgctgcctactgctttagaaatgtgcaggataattgctgccttcgccctctttacattgattttaagagggatcttgg atggaaatggatccatgaacccaaagggtacaatgctaacttctgtgctggggcatgcccatatctatggagttcagacactcaacacac caaagtcctcagcctgtacaacaccataaatcccgaagcttccgcttcccttgctgtgtgtcccaggatctggaaccactgaccattctct attacattggaaatacgcccaagatcgaacagctttccaatatgattgtcaagtcttgtaaatgcagctaa TGFB2 Human (nucleic acid sequence):

(SEQ ID NO: 318)

Atgcactactgtgtgctgagcgcttttctgatcctgcatctggtcacggtcgcgctcagcctgtctacctgcagcacactcgatatggacc agttcatgcgcaagaggatcgaggcgatccgcgggcagatcctgagcaagctgaagctcaccagtcccccagaagactatcctgagc ccgaggaagtcccccggaggtgatttccatctacaacagcaccagggacttgctccaggagaaggcgagccggagggcggccgc ctgcgagcgcgagaggagcgacgaagagtactacgccaaggaggtttacaaaatagacatgccgccttcttcccctccgaaactgtc tgcccagttgttacaacaccctctggctcagtgggcagcttgtgctccagacagtcccaggtgctctgtgggtaccttgatgccatcccgc ccactttctacagaccctacttcagaattgttcgatttgacgtctcagcaatggagaagaatgcttccaatttggtgaaagcagagttcaga gtctttcgtagcagaacccaaaagccagagtgcctgaacaacggattgagctatatcagattctcaagtccaaagatttaacatctccaac ccagcgctacatcgacagcaaagttgtgaaaacaagagcagaaggcgaatggctctccttcgatgtaactgatgctgttcatgaatggct tcaccataaagacaggaacctgggatttaaaataagcttacactgtccctgctgcacttttgtaccatctaataattacatcatcccaaataa aagtgaagaactagaagcaagatttgcaggtattgatggcacctccacatataccagtggtgatcagaaaactataaagtccactaggaa aaaaaacagtgggaagaccccacatctcctgctaatgttattgccctcctacagacttgagtcacaacagaccaac*cggcgg*tactgcg ccactgttcattgccaggactgtccttacgaacctgatccaccaaacacagttccaacttcctgtgaagctaaagaaggagaatgta ttgatagcagctgtggcacctgcacgagagacatactatcagatggactgtgtgaaaatataaccaggaaaaacatgttgccgaat gtgtcagtatgtaattgaatgcagagtagaggccgcaggatggtttagaacattctatggaaagagattccagttccaggaacctgg tacatacgtgtttgggtcaaggaaccaagggcggcgactggaaggtgtccatcaccctggagaacctggatggaaccaagggggg ctgtgctgaccaagacaagactggaagtggctggagacatcattgacatcgctcaagctactgagaatcccatcactgtaaacggt ggagctgaccctatcatcgccaacccgtacaccatcggcgaggtcaccatcgctgttgttgagatgccaggcttcaacatcaccgtc attgagttcttcaaactgatcgtgatcgacatcctcggaggaagatctgtaagaatcgcccagacacagcaaacaaaggaatga tctctggcctctgtggagatcttaaaatgatggaagatacagacttcacttcagatccagaacaactcgctattcagcctaagatcaa ccaggagtttgacgttgtccactctatggaaatcctgatgacgttgcatactgcaaaggtcttctggagccgtacaaggacagctg ccgcaaccccatcaacttctactactacaccatctcctgcgccttcgcccgctgtatgggtggagacgagcgagcctcacacgtgct gcttgactacagggagacgtgcgctgctcccgaaactagaggaacctgcgttttgtctggacatactttctacgatacatttgacaaa

```
gcaagataccaattccagggtccctgcaaggagattcttatggccgccgactgtttctggaacacttgggatgtgaaggtttcacac aggaatgttgactcttacactgaagtagagaaagtacgaatcaggaaacaatcgactgtagtagaactcattgttgatgaaaaca gattctggttggaggagaagccgtgtccgtcccgtacagctctcagaacacttccatctactggcaagatggtgacatactgactac agccatcctacctgaagctctggtggtcaagttcaacttcaagcaactgctcgtcgtacatattagagatccattcgatggtaagactt gcggtatttgcggtaactacaaccaggatttcagtgatgattcttttgatgctgaaggagcctgtgatctgaccccaacccaccggg atgcaccgaagaacagaaacctgaagctgaacgactctgcaatagtctcttcgccggtcaaagtgatcttgatcagaaatgtaacg tgtgccacaagcctgaccgtgtcgaacgatgcatgtacgagtattgcctgagggacaacagggtttctgtgaccacgcatgggag ttcaagaaagaatgctacataaagcatggagacaccctagaagtaccagatgaatgcaaacggcggaagaagcgtgctttggat gcggcctattgctttagaaatgtgcaggataattgctgcctacgtccactttacattgatttcaagagggatctagggtggaaatggataca cgaacccaaagggtacaatgccaacttctgtgctggagcatgcccgtatttatggagttcagacactcagcacagcagggtcctgagctt atataataccataaatccagaagcatctgcttctccttgctgcgtgtcccaagatttagaacctctaaccattctctactacattggcaaaaca cccaagattgaacagctttctaatatgattgtaaagtcttgcaaatgcagctaa
```

TGFB3 Mouse (nucleic acid sequence):

(SEQ ID NO: 319)

```
Atgaagatgcacttgcaaagggctctggtagtcctggccctgctgaacttggccacaatcagcctctctctgtccacttgcaccacgttg gacttcggccacatcaagaagaagagggtggaagccattaggggacagatcttgagcaagctcaggctcaccagcccccctgagcc atcggtgatgacccacgtcccctatcaggtcctggcactttacaacagcacccgggagttgctggaagagatgcacggggagaggga ggaaggctgcactcaggagacctcggagtctgagtactatgccaaagagatccataaaattcgacatgatccagggactggcggagca caatgaactggccgtctgccccaaaggaattacctctaaggttttttcgtttcaatgtgtcctcagtggagaaaaatggaaccaatctgttcc gggcagagttccgggtcttgcgggtgcccaaccccagctccaagcgcacagagcagagaattgagctcttccagatacttcgaccgg atgagcacatagccaagcagcgctacataggtggcaagaatctgcccacaaggggcaccgctgaatggctgtctttcgatgtcactga cactgtgcgcgagtggctgttgaggagagagtccaacttgggtctggaaatcagcatccactgtccatgtcacaccttcagcccaatgg agacatactggaaaatgttcatgaggtgatgaaatcaaattcaaaggagtggacaatgaagatgaccatgccgtggagacctgggg cgtctcaagaagcaaaaggatcaccacaacccacacctgatcctcatgatgatccccccacaccgactggacagcccaggccagggc agtcagaggaagtactgcgccactgttcattgccaggactgtccttacgaacctgatccaccaaacacagttccaacttcctgtgaag ctaaagaaggagaatgtattgatagcagctgtggcacctgcacgagagacatactatcagatggactgtgtgaaaataaaccag gaaaaacatgttgccgaatgtgtcagtatgtaattgaatgcagagtagaggccgcaggatggtttagaacattctatggaaagaga ttccagttccaggaacctggtacatacgtgttgggtcaaggaaccaagggcggcgactgaaggtgtccatcaccctggagaacc tggatggaaccaaggggctgtgctgaccaagacaagactggaagtggctggagacatcattgacatcgctcaagctactgaga atcccatcactgtaaacggtggagctgaccctatcatcgccaacccgtacaccatcggcgaggtcaccatcgctgttgttgagatgc caggcttcaacatcaccgtcattgagttcttcaaactgatcgtgatcgacatcctcggaggaagatctgtaagaatcgccccagaca cagcaaacaaggaatgatctctggcctctgtggagatcttaaaatgatggaagatacagacttcacttcagatccagaacaactc gctattcagcctaagatcaaccaggagtttgacggttgtccactctatggaaatcctgatgacgttgcatactgcaaaggtcttctgga gccgtacaaggacagctgccgcaaccccatcaacttctactactacaccatctcctgcgccttcgcccgctgtatgggtggagacga gcgagcctcacagtgctgcttgactacaggggacgtgcgctgctcccgaaactagaggaacctgcgttttgtctggacatactttc tacgatacatttgacaaagcaagataccaattccagggtccctgcaaggagattcttatggccgccgactgtttctggaacacttgg gatgtgaaggtttcacacaggaatgttgactcttacaactgaagtagagaaagtacgaatcaggaaacaatcgactgtagtagaact cattgttgatgaaaacagattctggttggaggagaagccgtgtccgtcccgtacagctctcagaacacttccatctactggcaaga tggtgacatactgactacagccatcctacctgaagctctggtggtcaagttcaacttcaagcaactgctcgtcgtacatattagagatc cattcgatggtaagacttgcggtatttgcggtaactacaaccaggatttcagtgatgattcttttgatgctgaaggagcctgtgatctga ccccaacccaccgggatgcaccgaagaacagaaacctgaagctgaacgactctgcaatagtctcttcgccggtcaaagtgatct
```

-continued

```
tgatcagaaatgtaacgtgtgccacaagcctgaccgtgtcgaacgatgcatgtacgagtattgcctgaggggacaacagggtttct gtgaccacgcatggagttcaagaaagaatgctacataaagcatggagacacccctagaagtaccgatgaatgcaaaaggaag aagagggccctggacaccaattactgcttccgcaacctggaggagaactgctgtgtacgccccctttatattgacttccggcaggatcta ggctggaaaatgggtccacgaacctaaggggttactatgccaacttctgctcaggcccttgcccatacctccgcagcgcagacacaaccc atagcacggtgcttggactatacaacaccctgaacccagaggcgtctgcctcgccatgctgcgtccccaggacctggagcccctgac catcttgtactatgtgggcagaaccccaaggtggagcagctgtccaacatggtggtgaagtcgtgtaagtgcagctga
```

TGFB3 Human (nucleic acid sequence):

(SEQ ID NO: 320)
```
Atgaagatgcacttgcaaagggctctggtggtcctggccctgctgaactttgccaccggtcagcctctctctgtccacttgcaccaccttg gacttcggccacatcaagaagaagagggtggaagccattaggggacagatcttgagcaagctcaggctcaccagccccctgagcc aacggtgatgacccacgtcccctatcaggtcctggccctttacaacagcacccgggagctgctggaggagatgcatggggagaggga ggaaggctgcacccaggaaaacaccgagtcggaatactatgccaaagaaatccataaattcgacatgatccaggggctggcggagc acaacgaactggctgtctgccctaaaggaattacctccaaggttttccgcttcaatgtgtcctcagtggagaaaaatagaaccaacctatt ccgagcagaattccgggtcttgcgggtgcccaaccccagctctaagcggaatgagcagaggatcgagctcttccagatccttcggcca gatgagcacattgccaaacagcgctatatcggtggcaagaatctgcccacacggggcactgccgagtggctgtcctttgatgtcactga cactgtgcgtgagtggctgttgagaagagagtccaacttaggtctagaaatcagcattcactgtccatgtcacacctttcagcccaatgga gatatcctggaaaacattcacgaggtgatggaaatcaaattcaaaggcgtggacaatgaggatgaccatggccgtggagatctggggc gcctcaagaagcagaaggatcaccacaaccctcatctaatcctcatgatgattcccccacaccggctcgacaacccgggccaggggg gtcagaggaagtactgcgccactgttcattgccaggactgtccttacgaacctgatccaccaaacacagttccaacttcctgtgaagc taaagaaggagaatgtattgatagcagctgtggcacctgcacgagagacatactatcagatggactgtgaaaataaaccagg aaaaacatgttgccgaatgtgtcagtatgtaattgaatgcagagtagaggccgcaggatggtttagaacattctatggaaagagatt ccagttccaggaacctggtacatacgtgtgggtcaaggaaccaagggcggcgactggaaggtgtccatcacccctggagaacct ggatggaaccaaggggggctgtgctgaccaagacaagactggaagtggctggagacatcattgacatcgctcaagctactgaga atcccatcactgtaaacggtggagctgaccctatcatcgccaacccgtacaccatcggcgaggtcaccatcgctgttgttgagatgc caggcttcaacatcaccgtcattgagttcttcaaactgatcgtgatcgacatcctcggaggaagatctgtaagaatcgccccagaca cagcaaacaaggaatgatctctggcctctgtggagatcttaaaatgatggaagatacagacttcacttcagatccagaacaactc gctattcagcctaagatcaaccaggagtttgacggttgtccactctatggaaatcctgatgacgttgcatactgcaaaggtcttctgga gccgtacaaggacagctgccgcaacccccatcaacttctactactacaccatctcctgcgccttcgcccgctgtatgggtggagacga gcgagcctcacacgtgctgcttgactacagggagacgtgcgctgctcccgaaactagaggaacctgcgttttgtctggacatactttc tacgatacatttgacaaagcaagataccaattccagggtccctgcaaggagattcttatggccgccgactgtttctggaacacttgg gatgtgaaggttttcacacaggaatgttgactcttacactgaagtagagaaagtacgaatcaggaaacaatcgactgtagtagaact cattgttgatgaaaacagattctggttggaggagaagccgtgtccgtcccgtacagctctcagaacacttccatctactggcaaga tggtgacatactgactacagccatcctacctgaagctctggtggtcaagttcaacttcaagcaactgctcgtcgtacatattagagatc cattcgatggtaagacttgcggtatttgcggtaactacaaccaggatttcagtgatgattcttttgatgctgaaggagcctgtgatctga cccccaacccacgggatgcaccgaagaacagaaacctgaagctgaacgactctgcaatagtctcttcgccggtcaaagtgatct tgatcagaaatgtaacgtgtgccacaagcctgaccgtgtcgaacgatgcatgtacgagtattgcctgaggggacaacagggtttct gtgaccacgcatggagttcaagaaagaatgctacataaagcatggagacacccctagaagtaccagatgaatgcaaaaggaag aagcgggctttggacaccaattactgcttccgcaacttggaggagaactgctgtgtgcgccccctctacattgacttccgacaggatctg ggctggaagtgggtccatgaacctaagggctactatgccaacttctgctcaggcccttgcccatacctccgcagtgcagacacaaccca cagcacggtgctgggactgtacaacactctgaaccctgaagcatctgcctcgccttgctgcgtgccccaggacctggagcccctgacc atcctgtactatgttgggaggaccccaaagtggagcagctctccaacatggtggtgaagtcttgtaaatgtagctga
```

PDGFA Mouse (nucleic acid sequence):

(SEQ ID NO: 321)

Atgaggacctgggcttgcctgctgctcctcggctgcggataccctcgcccatgccctggccgaggaagccgagatacccccgggagttg
atcgagcggctggctcgaagtcagatccacagcatccgggacctccagcgactcttggagatagactccgtaggggctgaggatgcc
ttggagacaagtctgagagcccatgggtcccatgccattaaccatgtgcccgagaagcggcctgtgcccatt cgcaggtactgcgcca
ctgttcattgccaggactgtccttacgaacctgatccaccaaacacagttccaacttcctgtgaagctaaagaaggagaatgtattga
tagcagctgtggcacctgcacgagagacatactatcagatggactgtgtgaaaataaaccaggaaaaacatgttgccgaatgtgt
cagtatgtaattgaatgcagagtagaggccgcaggatggtttagaacattctatggaaagagattccagttccaggaacctggtac
atacgtgttgggtcaaggaaccaagggcggcgactggaaggtgtccatcaccctggagaacctggatggaaccaaggggctgt
gctgaccaagacaagactggaagtggctggagacatcattgacatcgctcaagctactgagaatccatcactgtaaacggtgga
gctgaccctatcatcgccaacccgtacaccatcggcgaggtcaccatcgctgttgttgagatgccaggcttcaacatcaccgtcattg
agttcttcaaactgatcgtgatcgacatcctcggaggaagatctgtaagaatcgccccagacacagcaaacaaggaatgatctct
ggcctctgtggagatcttaaaatgatggaagatacagacttcacttcagatccgaacaactcgctattcagcctaagatcaaccag
gagtttgacggttgtccactctatggaaatcctgatgacgttgcatactgcaaaggtcttctggagccgtacaaggacagctgccgc
aacccccatcaacttctactactacaccatctcctgcgccttcgcccgctgtatgggtgggagacgagcagcctcacacgtgctgcttg
actacagggagacgtgcgctgctcccgaaactagaggaacctgcgttttgtctggacatactttctacgatacatttgacaaagcaa
gataccaattccagggtccctgcaaggagattcttatggccgccgactgtttctggaacacttgggatgtgaaggtttcacacagga
atgttgactcttacactgaagtagagaaagtacgaatcaggaaacaatcgactgtagtagaactcattgttgatggaaaacagattc
tggttggaggagaagccgtgtccgtcccgtacagctctcagaacacttccatctactggcaagatggtgacatactgactacagcca
tcctacctgaagctctggtggtcaagttcaacttcaagcaactgctcgtcgtacatattagagatccattcgatggtaagacttgcggt
atttgcggtaactacaaccaggatttcagtgatgattcttttgatgctgaaggagcctgtgatctgaccccaacccaccgggatgca
ccgaagaacagaaacctgaagctgaacgactctgcaatagtctcttcgccggtcaaagtgatcttgatcagaaatgtaacgtgtgc
cacaagcctgaccgtgtcgaacgatgcatgtacgagtattgcctgaggggacaacagggtttctgtgaccacgcatgggagttcaa
gaaagaatgctacataaagcatggagacacctagaagtaccagatgaatgcaaacgcaggaagagaagtattgaggaagccat
tcctgcagtttgcaagaccaggacggtcatttacgagatacctcggagccaggtggaccccacatcggccaacttcctgatctggcccc
cagtgtgtggaggtgaagcgctgcactggctgttgtaacaccagcagcgtcaagtgccagccttcacgggtccaccaccgcagtgtcaa
ggtggccaaagtggagtatgtcaggaagaagccaaaattgaaagaggtccaggtgaggttagaggaacacctggagtgtgcatgtgc
gacctccaacctgaacccagaccatcgggaggaggagacagatgtgaggtga PDGFA Human (nucleic acid sequence):

(SEQ ID NO: 322)

Atgaggaccttggcttgcctgctgctcctcggctgcggataccctcgcccatgttctggccgaggaagccgagatcccccgcgaggtga
tcgagaggctggcccgcagtcagatccacagcatccgggacctccagcgactcctggagatagactccgtaggggagtgaggattcttt
ggacaccagcctgagagctcacggggtccatgccactaagcatgtgcccgagaagcggccctgcccatt cggaggtactgcgcca
ctgttcattgccaggactgtccttacgaacctgatccaccaaacacagttccaacttcctgtgaagctaaagaaggagaatgtattga
tagcagctgtggcacctgcacgagagacatactatcagatggactgtgtgaaaataaaccaggaaaaacatgttgccgaatgtgt
cagtatgtaattgaatgcagagtagaggccgcaggatggtttagaacattctatggaaagagattccagttccaggaacctggtac
atacgtgttgggtcaaggaaccaagggcggcgactggaaggtgtccatcaccctggagaacctggatggaaccaaggggctgt
gctgaccaagacaagactggaagtggctggagacatcattgacatcgctcaagctactgagaatccatcactgtaaacggtgga
gctgaccctatcatcgccaacccgtacaccatcggcgaggtcaccatcgctgttgttgagatgccaggcttcaacatcaccgtcattg
agttcttcaaactgatcgtgatcgacatcctcggaggaagatctgtaagaatcgccccagacacagcaaacaaggaatgatctct
ggcctctgtggagatcttaaaatgatggaagatacagacttcacttcagatccgaacaactcgctattcagcctaagatcaaccag
gagtttgacggttgtccactctatggaaatcctgatgacgttgcatactgcaaaggtcttctggagccgtacaaggacagctgccgc

```
aaccccatcaacttctactactacaccatctcctgcgccttcgcccgctgtatgggtggagacgagcgagcctcacacgtgctgcttg actacagggagacgtgcgctgctcccgaaactagaggaacctgcgttttgtctggacatactttctacgatacatttgacaaagcaa gataccaattccagggtccctgcaaggagattcttatggccgccgactgtttctggaacacttgggatgtgaaggtttcacacagga atgttgactcttacactgaagtagagaaagtacgaatcaggaaacaatcgactgtagtagaactcattgttgatggaaaacagattc tggttggaggagaagccgtgtccgtcccgtacagctctcagaacacttccatctactggcaagatggtgacatactgactacagcca tcctacctgaagctctggtggtcaagttcaacttcaagcaactgctcgtcgtacatattagagatccattcgatggtaagcttgcggt atttgcggtaactacaaccaggatttcagtgatgattcttttgatgctgaaggagcctgtgatctgaccccaacccaccgggatgca ccgaagaacagaaacctgaagctgaacgactctgcaatagtctcttcgccggtcaaagtgatcttgatcagaaatgtaacgtgtgc cacaagcctgaccgtgtcgaacgatgcatgtacgagtattgcctgaggggacaacagggtttctgtgaccacgcatgggagttcaa gaaagaatgctacataaagcatggagacaccctagaagtaccagatgaatgcaaacggaggaagagaagcatcgaggaagctg
```
(underline: cggagg)
```
tccccgctgtctgcaagaccaggacggtcatttacgagattcctcggagtcaggtcgaccccacgtccgccaacttcctgatctggccc ccgtgcgtggaggtgaaacgctgcaccggctgctgcaacacgagcagtgtcaagtgccagccctcccgcgtccaccaccgcagcgt caaggtggccaaggtggaatacgtcaggaagaagccaaaattaaaagaagtccaggtgaggttagaggagcatttggagtgcgcctg cgcgaccacaagcctgaatccggattatcgggaagaggacacgggaaggcctagggagtcaggtaaaaaacggaaaagaaaaag gttaaaacccacctaa BDNF Mouse (nucleic acid sequence):
```
(SEQ ID NO: 323)
```
Atgttccaccaggtgagaagagtgatgaccatcctttttccttactatggttatttcatacttcggttgcatgaaggcggcgcccatgaaaga agtaaacgtccacggacaaggcaacttggcctacccaggtgtgcggacccatgggactctggagagcgtgaatgggcccagggcag gttcgagaggtctgacgacgacatcactggctgacacttttgagcacgtcatcgaagagctgctggatgaggaccagaaggttcggcc caacgaagaaaaccataaggacgcggacttgtacacttcccgggtgatgctcagcagtcaagtgcctttggagcctcctctactctttctg ctggaggaatacaaaaaattacctggatgccgcaaacatgtctatgagggttcggcgctactgcgccactgttcattgccaggactgtcct
```
(underline: cggcgc)
```
tacgaacctgatccaccaaacacagttccaacttcctgtgaagctaaagaaggagaatgtattgatagcagctgtggcacctgcac gagagacatactatcagatggactgtgtgaaaataaaccaggaaaaacatgttgccgaatgtgtcagtatgtaattgaatgcaga gtagaggccgcaggatggttagaacattctatggaaagagattccagttccaggaacctggtacatacgtgttgggtcaaggaac caagggcggcgactggaaggtgtcctcatcaccctgagaacctggatggaaccaaggggctgtgctgaccaagacaagactg gaagtggctggagacatcattgacatcgctcaagctactgagaatcccatcactgtaaacggtggagctgaccctatcatcgccaa cccgtacaccatcggcgaggtcaccatcgctgttgttgagatgccaggcttcaacatcaccgtcattgagttcttcaaactgatcgtga tcgacatcctcggaggaagatctgtaagaatcgcccagacacagcaaacaaaggaatgatctctggcctctgtggagatcttaa aatgatggaagatacagacttcacttcagatccagaacaactcgctattcagcctaagatcaaccaggagtttgacggttgtccact ctatggaaatcctgatgacgttgcatactgcaaaggtcttctggagccgtacaaggacagctgccgcaacccatcaacttctacta ctacaccatctcctgcgccttcgcccgctgtatgggtggagacgagcgagcctcacacgtgctgcttgactacagggagacgtgcg ctgctcccgaaactagaggaacctgcgttttgtctggacatactttctacgatacatttgacaaagcaagataccaattccagggtcc ctgcaaggagattcttatggccgccgactgtttctggaacacttgggatgtgaaggtttcacacaggaatgttgactcttacactgaa gtagagaaagtacgaatcaggaaacaatcgactgtagtagaactcattgttgatggaaaacagattctggttggaggagaagccg tgtccgtcccgtacagctctcagaacacttccatctactggcaagatggtgacatactgactacagccatcctacctgaagctctggt ggtcaagttcaacttcaagcaactgctcgtcgtacatattagagatccattcgatggtaagcttgcggtatttgcggtaactacaacc aggatttcagtgatgattcttttgatgctgaaggagcctgtgatctgaccccaacccaccgggatgcaccgaagaacagaaacct gaagctgaacgactctgcaatagtctcttcgccggtcaaagtgatcttgatcagaaatgtaacgtgtgccacaagcctgaccgtgtc gaacgatgcatgtacgagtattgcctgaggggacaacagggtttctgtgaccacgcatgggagttcaagaaagaatgctacataa agcatggagacaccctagaagtaccagatgaatgcaaacggcgccactccgaccctgcccgcgtggggagctgagcgtgtgtg
```
(underline: cggcgc)
```
acagtattagcgagtgggtcacagcggcagataaaaaagactgcagtggacatgtctggcgggacggtcacagtcctagagaaagtcc
``` cggtatccaaaggccaactgaagcagtatttctacgagaccaagtgtaatcccatgggttacaccaaggaaggctgcaggggcataga caaaaggcactggaactcgcaatgccgaactacccaatcgtatgttcgggcccttactatggatagcaaaaagagaattggctggcgat tcataaggatagacacttcctgtgtatgtacactgaccattaaaaggggaagatag BDNF Human (nucleic acid sequence):

(SEQ ID NO: 324)

Atgaccatccttttccttactatggttatttcatactttggttgcatgaaggctgcccccatgaaagaagcaaacatccgaggacaaggtgg cttggcctaccaggtgtgcggacccatgggactctggagagcgtgaatgggcccaaggcaggttcaagaggcttgacatcattggct gacactttcgaacacgtgatagaagagctgttggatgaggaccagaaagttcggcccaatgaagaaaacaataaggacgcagacttgt acacgtccagggtgatgctcagtagtcaagtgccttggagcctcctcttctcttctctgctggaggaatacaaaaattacctagatgctgca aacatgtccatgagggtccggcgccactctgaccctgcccgccgatactgcgccactgttcattgccaggactgtccttacgaacctg atccaccaaacacagttccaacttcctgtgaagctaaagaaggagaatgtattgatagcagctgtggcacctgcacgagagacat actatcagatggactgtgtgaaaataaaccaggaaaaacatgttgccgaatgtgtcagtatgtaattgaatgcagagtagaggccg caggatggtttagaacattctatggaaagagattccagttccaggaacctggtacatacgtgtttgggtcaaggaaccaagggcggc gactggaaggtgtccatcaccctggagaacctggatggaaccaagggggctgtgctgaccaagacaagactggaagtggctgg agacatcattgacatcgctcaagctactgagaatcccatcactgtaaacggtggagctgaccctatcatcgccaacccgtacaccat cggcgaggtcaccatcgctgttgttgagatgccaggcttcaacatcaccgtcattgagttcttcaaactgatcgtgatcgacatcctcg gaggaagatctgtaagaatcgccccagacacagcaaacaaaggaatgatctctggcctctgtggagatcttaaaatgatggaag atacagacttcacttcagatccagaacaactcgctattcagcctaagatcaaccaggagtttgacggttgtccactctatggaaatcc tgatgacgttgcatactgcaaaggtcttctggagccgtacaaggacagctgccgcaacccatcaacttctactactacaccatctcc tgcgccttcgcccgctgtatgggtggagacgagcgagcctcacacgtgctgcttgactacagggagacgtgcgctgctcccgaaac tagaggaacctgcgttttgtctggacatactttctacgatacatttgacaaagcaagataccaattccagggtccctgcaaggagatt cttatggccgccgactgtttctggaacacttgggatgtgaaggtttcacacaggaatgttgactcttacactgaagtagaaaagtac gaatcaggaaacaatcgactgtagtagaactcattgttgatggaaaacagattctggttggaggagaagccgtgtccgtcccgtac agctctcagaacacttccatctactggcaagatggtgacatactgactacagccatcctacctgaagctctggtggtcaagttcaact tcaagcaactgctcgtcgtacatattagagatccattcgatggtaagacttgcggtatttgcggtaactacaaccaggatttcagtgat gattcttttgatgctgaaggagcctgtgatctgaccccaacccaccggatgcaccgaagaacagaaacctgaagctgaacgac tctgcaatagtctcttcgccggtcaaagtgatcttgatcagaaatgtaacgtgtgccacaagcctgaccgtgtcgaacgatgcatgta cgagtattgcctgagggacaacagggtttctgtgaccacgcatgggagttcaagaaagaatgctacataaagcatggagacac cctagaagtaccagatgaatgcaaacgccgagggggagctgagcgtgtgtgacagtattagtgagtgggtaacggcggcagacaaa aagactgcagtggacatgtcgggcgggacggtcacagtccttgaaaaggtccctgtatcaaaaggccaactgaagcaatacttctacg agaccaagtgcaatcccatgggttacacaaaagaaggctgcaggggcatagacaaaaggcattggaactcccagtgccgaactaccc agtcgtacgtgcgggcccttaccatggatagcaaaagagaattggctggcgattcataaggatagacacttcttgtgtatgtacattgac cattaaaaggggaagatag NGF Mouse (nucleic acid sequence):

(SEQ ID NO: 325)

Atgtccatgttgttctacactctgatcactgcgttttttgatcggcgtacaggcagaaccgtacacagatagcaatgtcccagaaggagact ctgtccctgaagcccactggactaaacttcagcattcccttgacacagccctccgcagagcccgcagtgcccctactgcaccaatagct gcccgagtgacagggcagacccgcaacatcactgtagaccccagactgtttaagaaacggagactccactcaccccgtgtgctgttca gcacccagcctccaccacctcttcagacactctggatctagacttccaggcccatggtacaatccctttcaacaggactcaccggagc aagcgctactgcgccactgttcattgccaggactgtccttacgaacctgatccaccaaacacagttccaacttcctgtgaagctaaag aaggagaatgtattgatagcagctgtggcacctgcacgagagacatactatcagatggactgtgtgaaaataaaccaggaaaaa catgttgccgaatgtgtcagtatgtaattgaatgcagagtagaggccgcaggatggtttagaacattctatggaaagagattccagtt -continued ccaggaacctggtacatacgtgttgggtcaaggaaccaagggcggcgactggaaggtgtccatcaccctggagaacctggatgg aaccaagggggctgtgctgaccaagacaagactggaagtggctgagacatcattgacatcgctcaagctactgagaatccat cactgtaaacggtggagctgaccctatcatcgccaacccgtacaccatcggcgaggtcaccatcgctgttgttgagatgccaggctt caacatcaccgtcattgagttcttcaaactgatcgtgatcgacatcctcggaggaagatctgtaagaatcgcccagacacagcaa acaaaggaatgatctctggcctctgtggagatcttaaaatgatggaagatacagacttcacttcagatccagaacaactcgctattc agcctaagatcaaccaggagtttgacggttgtccactctatggaaatcctgatgacgttgcatactgcaaaggtcttctggagccgta caaggacagctgccgcaaccccatcaacttctactactacaccatctcctgcgccttcgcccgctgtatgggtggagacgagcgag cctcacacgtgctgcttgactacagggagacgtgcgctgctcccgaaactagaggaacctgcgttttgtctggacatactttctacga tacatttgacaaagcaagataccaattccagggtccctgcaaggagattcttatggccgccgactgtttctggaacacttgggatgtg aaggtttcacacaggaatgttgactcttacactgaagtagagaaagtacgaatcaggaaacaatcgactgtagtagaactcattgtt gatggaaaacagattctggttggaggagaagccgtgtccgtcccgtacagctctcagaacacttccatctactggcaagatggtga catactgactacagccatcctacctgaagctctggtggtcaagttcaacttcaagcaactgctcgtcgtacatattagagatccattcg atggtaagacttgcggtatttgcggtaactacaaccaggatttcagtgatgattcttttgatgctgaaggagcctgtgatctgaccccc aacccaccgggatgcaccgaagaacagaaacctgaagctgaacgactctgcaatagtctcttcgccggtcaaagtgatcttgatc agaaatgtaacgtgtgccacaagcctgaccgtgtcgaacgatgcatgtacgagtattgcctgaggggacaacagggtttctgtgac cacgcatgggagttcaagaaagaatgctacataaagcatggagacaccctagaagtaccagatgaatgcaaa<u>aagcgc</u>tcatcc acccacccagtcttccacatggggagttctcagtgtgtgacagtgtcagtgtgtggttggagataagaccacagccacagacatcaa gggcaaggaggtgacagtgctggccgaggtgaacattaacaacagtgtattcagacagtacttttgagaccaagtgccgagcctcca atcctgttgagagtgggtgccggggcatcgactccaaacactggaactcatactgcaccacgactcacaccttcgtcaaggcgttgaca acagatgagaagcaggctgcctggaggttcatccggatagacacagcctgtgtgtgtgtgctcagcaggaaggctacaagaagaggc tga NGF Human (nucleic acid sequence):

(SEQ ID NO: 326)

Atgtccatgttgttctacactctgatcacagcttttctgatcggcatacaggcggaaccacactcagagagcaatgtccctgcaggacac aaccatcccccaagcccactggactaaacttcagcattcccttgacactgccttcgcagagcccgcagcgccccggcagcggcgata gctgcacgcgtggcggggcagacccgcaacattactgtggacccaggctgtttaaaaagcggcgactccgttcacccgtgtgctgt ttagcacccagcctccccgtgaagctgcagacactcaggatctggacttcgaggtcggtggtgctgcccccttcaacaggactcacag gagc<u>aagcgg</u>tactgcgccactgttcattgccaggactgtccttacgaacctgatccaccaaacacagttccaacttcctgtgaagct aaagaaggagaatgtattgatagcagctgtggcacctgcacgagagacatactatcagatggactgtgtgaaaataaaccagga aaaacatgttgccgaatgtgtcagtatgtaattgaatgcagagtagaggccgcaggatggtttagaacattctatggaaagagattc cagttccaggaacctggtacatacgtgttgggtcaaggaaccaagggcggcgactggaaggtgtccatcaccctggagaacctg gatgaaccaagggggctgtgctgaccaagacaagactggaagtggctgagacatcattgacatcgctcaagctactgagaat cccatcactgtaaacggtggagctgaccctatcatcgccaacccgtacaccatcggcgaggtcaccatcgctgttgttgagatgcca ggcttcaacatcaccgtcattgagttcttcaaactgatcgtgatcgacatcctcggaggaagatctgtaagaatcgcccagacaca gcaaacaaaggaatgatctctggcctctgtggagatcttaaactgatggaagatacagacttcacttcagatccagaacaactcgc tattcagcctaagatcaaccaggagtttgacggttgtccactctatggaaatcctgatgacgttgcatactgcaaaggtcttctggagc cgtacaaggacagctgccgcaaccccatcaacttctactactacaccatctcctgcgccttcgcccgctgtatgggtggagacgagc gagcctcacacgtgctgcttgactacagggagacgtgcgctgctcccgaaactagaggaacctgcgttttgtctggacatactttcta cgatacatttgacaaagcaagataccaattccagggtccctgcaaggagattcttatggccgccgactgtttctggaacacttggga tgtgaaggtttcacacaggaatgttgactcttacactgaagtagagaaagtacgaatcaggaaacaatcgactgtagtagaactca ttgttgatggaaaacagattctggttggaggagaagccgtgtccgtcccgtacagctctcagaacacttccatctactggcaagatg gtgacatactgactacagccatcctacctgaagctctggtggtcaagttcaacttcaagcaactgctcgtcgtacatattagagatcc -continued attcgatggtaagacttgcggtatttgcggtaactacaaccaggatttcagtgatgattcttttgatgctgaaggagcctgtgatctgac ccccaacccaccgggatgcaccgaagaacagaaacctgaagctgaacgactctgcaatagtctcttcgccggtcaaagtgatctt gatcagaaatgtaacgtgtgccacaagcctgaccgtgtcgaacgatgcatgtacgagtattgcctgaggggacaacagggtttctg tgaccacgcatgggagttcaagaaagaaatgctacataaagcatggagacacccctagaagtaccagatgaatgcaaa<u>aagcggt</u> catcatcccatcccatcttccacaggggcgaattctcggtgtgtgacagtgtcagcgtgtgggttgggataagaccaccgccacagac atcaagggcaaggaggtgatggtgttgggagaggtgaacattaacaacagtgtattcaaacagtactttttgagaccaagtgccggga cccaaatcccgttgacagcgggtgccggggcattgactcaaagcactggaactcatattgtaccacgactcacacctttgtcaaggcgc tgaccatggatggcaagcaggctgcctggcggtttatccggatagatacggcctgtgtgtgtgtgctcagcaggaaggctgtgagaag agcctga Albumin Mouse (nucleic acid sequence):

(SEQ ID NO: 327)

Atgaagtgggtaacctttctcctcctcctcttcgtctccggctctgcttttttccaggggtgtgttt<u>cgccga</u>tactgcgccactgttcattgcc aggactgtccttacgaacctgatccaccaaacacagttccaacttcctgtgaagctaaagaaggagaatgtattgatagcagctgt ggcacctgcacgagagacatactatcagatggactgtgtgaaaataaaccaggaaaaacatgttgccgaatgtgtcagtatgtaa ttgaatgcagagtagaggccgcaggatggtttagaacattctatggaaagagattccagttccaggaacctggtacatacgtgttgg gtcaaggaaccaagggcggcgactggaaggtgtccatcaccctggagaacctggatggaaccaagggggctgtgctgaccaa gacaagactggaagtggctggagacatcattgacatcgctcaagctactgagaatcccatcactgtaaacggtggagctgaccct atcatcgccaacccgtacaccatcggcgaggtcaccatcgctgttgttgagatgccaggcttcaacatcaccgtcattgagttcttca aactgatcgtgatcgacatcctcggaggaagatctgtaagaatcgcccagacacagcaaacaaaggaatgatctctggcctctg tggagatcttaaaatgatggaagatacagacttcacttcagatccagaacaactcgctattcagcctaagatcaaccaggagtttga cggttgtccactctatggaaatcctgatgacgttgcatactgcaaaggtcttctggagccgtacaaggacagctgccgcaaccccat caacttctactactacaccatctcctgcgcgcttcgcccgctgtatgggtggagacagagcgagcctcacacgtgctgcttgactacagg gagacgtgcgctgctcccgaaactagaggaacctgcgttttgtctggacatactttctacgatacatttgacaaagcaagataccaa ttccagggtccctgcaaggagattcttatggccgccgactgtttctggaacacttgggatgtgaaggtttcacacaggaatgttgactc ttacactgaagtagagaaagtacgaatcaggaaacaatcgactgtagtagaactcattgttgatggaaaacagattctggttggag gagaagccgtgtccgtcccgtacagctctcagaacacttccatctactggcaagatggtgacatactgactacagccatcctacctg aagctctggtggtcaagttcaacttcaagcaactgctcgtcgtacatattagagatccattcgatggtaagacttgcggtatttgcggt aactacaaccaggatttcagtgatgattcttttgatgctgaaggagcctgtgatctgaccccccaacccaccgggatgcaccgaaga acagaaacctgaagctgaacgactctgcaatagtctcttcgccggtcaaagtgatcttgatcagaaatgtaacgtgtgccacaagc ctgaccgtgtcgaacgatgcatgtacgagtattgcctgaggggacaacagggtttctgtgaccacgcatgggagttcaagaaaga atgctacataaagcatggagacaccctagacgtaccagatgaatgcaaa<u>cgccga</u>gaagcacacaagagtgagatcgcccatcg gtataatgatttgggagaacaacatttcaaaggcctagtcctgattgccttttcccagtatctccagaaatgctcatacgatgagcatgcca aattagtgcaggaagtaacagactttgcaaagacgtgtgttgccgatgagtctgccgccaactgtgacaaatcccttcacactctttttga gataagttgtgtgccattccaaacctccgtgaaaactatggtgaactggctgactgctgtacaaaacaagagcccgaaagaaacgaatg tttcctgcaacacaaagatgacaaccccagcctgccaccatttgaaaggccagaggctgaggccatgtgcacctcctttaaggaaaacc caaccacctttatgggacactatttgcatgaagttgccagaagacatccttattctatgccccagaacttcttactatgctgagcagtacaa tgagattctgacccagtgttgtgcagaggctgacaaggaaagctgcctgaccccgaagcttgatggtgtgaaggagaaagcattggtct catctgtccgtcagagaatgaagtgctccagtatgcagaagtttggagagagagcttttaaagcatgggcagtagctcgtctgagcag acattccccaatgctgactttcagaaatcaccaaattggcaacagacctgaccaaagtcaacaaggagtgctgccatggtgacctgct ggaatgcgcagatgacagggcggaacttgccaagtacatgtgtgaaaaccaggcgactatctccagcaaactgcagacttgctgcgat aaaccactgttgaagaaagcccactgtcttagtgaggtggagcatgacaccatgcctgctgatctgcctgccattgctgctgattttgttga -continued ggaccaggaagtgtgcaagaactatgctgaggccaaggatgtcttcctgggcacgttcttgtatgaatattcaagaagacaccctgatta ctctgtatccctgttgctgagacttgctaagaaatatgaagccactctggaaaagtgctgcgctgaagcaatcctcccgcatgctacggc acagtgcttgctgaatttcagcctcttgtagaagagcctaagaacttggtcaaaaccaactgtgatctttacgagaagcttggagaatatgg attccaaaatgccattctagttcgctacacccagaaagcacctcaggtgtcaaccccaactctcgtggaggctgcaagaaacctaggaa gagtgggcaccaagtgttgtacacttcctgaagatcagagactgccttgtgtggaagactatctgtctgcaatcctgaaccgtgtgtgtct gctgcatgagaagaccccagtgagtgagcatgttaccaagtgctgtagtggatccctggtggaaaggcggccatgcttctctgctctga cagttgatgaaacatatgtccccaaagagtttaaagctgagaccttcaccttccactctgatatctgcacacttccagagaaggagaagca gattaagaaacaaacggctcttgctgagctggtgaagcacaagcccaaggctacagcggagcaactgaagactgtcatggatgacttt gcacagttcctggatacatgttgcaaggctgctgacaaggacacctgcttctcgactgagggtccaaaccttgtcactagatgcaaagac gccttagcctaa Albumin Human (nucleic acid sequence):

(SEQ ID NO: 328)

atgaagtgggtaacctttatttcccttcttttctctttagctcggcttattccaggggtgtgttt<u>cgtcga</u>tactgcgccactgttcattgccag gactgtccttacgaacctgatccaccaaaacacagttccaacttcctgtgaagctaaagaaggagaatgtattgatagcagctgtggc acctgcacgagagacatactatcagatggactgtgtgaaaataaaccaggaaaaacatgttgccgaatgtgtcagtatgtaattga atgcagagtagaggccgcaggatggtttagaacattctatgaaagagattccagttccaggaacctggtacatacgtgttgggtc aaggaaccaagggcggcgactggaaggtgtccatcaccctggagaacctggatggaaccaagggggctgtgctgaccaagac aagactggaagtggctggagacatcattgacatcgctcaagctactgagaatcccatcactgtaaacggtggagctgaccctatca tcgccaacccgtacaccatcggcgaggtcaccatcgctgttgttgagatgccaggcttcaacatcaccgtcattgagttcttcaaact gatcgtgatcgacatcctcggaggaagatctgtaagaatcgcccagacacagcaaacaaaggaatgatctctggcctctgtgga gatcttaaaatgatggaagatacagacttcacttcagatccagaacaactcgctattcagcctaagatcaaccaggagtttgacggt tgtccactctatggaaatcctgatgacgttgcatactgcaaaggtcttctgagccgtacaaggacagctgccgcaaccccatcaac ttctactactacaccatctcctgcgccttcgcccgctgtatgggtggagacgagcgagcctcacacgtgctgcttgactacagggag acgtgcgctgctcccgaaactagaggaacctgcgttttgtctggacatactttctacgatacatttgacaaagcaagataccaattcc agggtccctgcaaggagattcttatggccgccgactgtttctggaacactttgggatgtgaaggtttcacacaggaatgttgactcttac actgaagtagagaaagtacgaatcaggaaacaatcgactgtagtagaactcattgttgatggaaaacagattctggttggaggag aagccgtgtccgtcccgtacagctctcagaacacttccatctactggcaagatggtgacatactgactacagccatcctacctgaag ctctggtggtcaagttcaacttcaagcaactgctcgtcgtacatattagagatcfcattcgatggtaagacttgcggtatttgcggtaact acaaccaggatttcagtgatgattcttttgatgctgaaaggagcctgtgatctgaccccaacccaccgggatgcaccgaagaacag aaacctgaagctgaacgactctgcaatagtctcttcgccggtcaaagtgatcttgatcagaaatgtaacgtgtgccacaagcctgac cgtgtcgaacgatgcatgtacgagtattgcctgagggacaacagggtttctgtgaccacgcatgggagttcaagaaagaatgcta cataaagcatggagacaccctagaagtaccagatgaatgcaaa<u>cgtcga</u>gatgcacacaagagtgaggttgctcatcggtttaaag atttgggagaagaaaatttcaaagccttggtgttgattgcctttgctcagtatcttcagcagtgtccatttgaagatcatgtaaaattagtgaat gaagtaactgaatttgcaaaaacatgtgttgctgatgagtcagctgaaaattgtgacaaatcacttcataccctttttggagacaaattatgc acagttgcaactcttcgtgaaacctatggtgaaatggctgactgctgtgcaaaacaagaacctgagagaaatgaatgcttcttgcaacac aaagatgacaacccaaacctccccgattggtgagaccagaggttgatgtgatgtgcactgcttttcatgacaatgaagagacatttttga aaaaatacttatatgaaattgccagaagacatccttacttttatgccccggaactccttttcttgctaaaaggtataaagctgcttttacagaa tgttgccaagctgctgataaagctgcctgcctgttgccaaagctcgatgaacttcgggatgaagggaaggcttcgtctgccaaacagag actcaagtgtgccagtctccaaaaatttggagaaagagctttcaaagcatgggcagtagctcgcctgagccagagatttcccaaagctg agtttgcagaagtttccaagttagtgacagatcttaccaaagtccacacggaatgctgccatggagatcttgcttgaatgtgctgatgacag ggcggaccttgccaagtatatctgtgaaaatcaagattcgatctccagtaaactgaaggaatgctgtgaaaaacctctgttggaaaaatcc cactgcattgccgaagtggaaaatgatgagatgcctgctgacttgccttcattagctgctgattttgttgaaagtaaggatgtttgcaaaaac

```
tatgctgaggcaaaggatgtcttcctgggcatgttttgtatgaatatgcaagaaggcatcctgattactctgtcgtgctgctgctgagactt
gccaagacatatgaaaccactctagagaagtgctgtgccgctgcagatcctcatgaatgctatgccaaagtgttcgatgaatttaaacctc
ttgtggaagagcctcagaatttaatcaaacaaaattgtgagcttttgagcagcttggagagtacaaattccagaatgcgctattagttcgtt
acaccaagaaagtaccccaagtgtcaactccaactcttgtagaggtctcaagaaacctaggaaaagtgggcagcaaatgttgtaaacat
cctgaagcaaaagatgccctgtgcagaagactatctatccgtggtcctgaaccagttatgtgtgttgcatgagaaacgccagtaagt
gacagagtcaccaaatgctgcacagaatccttggtgaacaggcgaccatgctttcagctctggaagtcgatgaaacatacgttcccaaa
gagtttaatgctgaaacattccacttccatgcagatatatgcacactttctgagaaggagagacaaatcaagaaacaaactgcacttgttg
agctcgtgaaacacaagcccaaggcaacaaaagagcaactgaaagctgttatggatgatttcgcagcttttgtagagaagtgctgcaag
gctgacgataaggagacctgctttgccgaggagggtaaaaaacttgttgctgcaagtcaagctgccttaggcttataa
```

Calcitonin Mouse (nucleic acid sequence): (SEQ ID NO: 329)

```
Atgggcttcctgaagttctccccttcctggttgtcagcatcttgctcctgtaccaggcatgcagcctccaggcagtgcctttgaggtcaat
cttggaaagcagcccaggcatggccactctcagtgaagaagaagttcgcctgctggctgcactggtgcaggactatatgcagatgaaa
gccagggagctggagcaggaggaagagcaggaggctgagggctctagcttgagacagccccagatctaagcggtactgcgccactg
ttcattgccaggactgtccttacgaacctgatccaccaaacacagttccaacttcctgtgaagctaaagaaggagaatgtattgata
gcagctgtggcacctgcacgagagacatactatcagatggactgtgtgaaaataaaccaggaaaaacatgttgccgaatgtgtca
gtatgtaattgaatgcagagtagaggccgcaggatggtttagaacattctatggaaagagattccagttccaggaacctggtacata
cgtgttgggtcaaggaaccaaggggcggcgactggaaggtgtccatcaccctggagaacctggatggaaccaaggggggctgtgct
gaccaagacaagactggaagtggctggagacatcattgacatcgctcaagctactgaggaatcccatcactgtaaacggtggagct
gaccctatcatcgccaaccgtacaccatcggcgaggtcaccatcgctgttgttgagatgccaggcttcaacatcaccgtcattgagt
tcttcaaactgatcgtgatcgacatcctcggaggaagatctgtaagaatcgcccagacacagcaaacaaaggaatgatctctgg
cctctgtggagatcttaaaatgatggaagatacagacttcacttcagatccagaacaactcgctattcagcctaagatcaaccagga
gtttgacggttgtccactctatggaaatcctgatgacgttgcatactgcaaaggtcttctggagccgtacaaggacagctgccgcaac
cccatcaacttctactactacaccatctcctgcgccttcgcccgctgtatgggtggagacgagcgagcctcacacgtgctgcttgact
acagggagacgtgcgctgctcccgaaactagaggaacctgcgttttgtctggacatactttctacgatacatttgacaaagcaagat
accaattccagggtccctgcaaggagattcttatggccgccgactgtttctggaacacttgggatgtgaaggtttcacacaggaatgt
tgactcttacactgaagtagagaaagtacgaatcaggaaacaatcgactgtagtagaactcattgttgatggaaaacagattctggt
tggaggagaagccgtgtccgtcccgtacagctctcagaacacttccatctactggcaagatggtgacatactgactacagccatcct
acctgaagctctggtggtcaagttcaacttcaagcaactgctcgtcgtacatattagagatccattcgatggtaagacttgcggtattt
gcggtaactacaaccaggatttcagtgatgattcttttgatgctgaaggagcctgtgatctgaccccaacccaccgggatgcaccg
aagaacagaaacctgaagctgaacgactctgcaatagtctcttcgccggtcaaagtgatcttgatcagaaatgtaacgtgtgccac
aagcctgaccgtgtcgaacgatgcatgtacgagtattgcctgaggggacaacaggggtttctgtgaccacgcatgggagttcaaga
agaatgctacataaagcatggagacacctagaagtaccagatgaatgcaaaaagcggtgtgggaatctgagtacctgcatgct
gggcacgtacacacaagacctcaacaagtttcacaccttcccccaaacttcaattgggggttgaagcacctggcaagaaagggatgtg
gccaaggacttggagacaaaccaccaatcccatttggcaactaa
```

Calcitonin Human (nucleic acid sequence): (SEQ ID NO: 330)

```
Atgggcttccaaaagttctccccttcctggctctcagcatcttggtcctgttgcaggcaggcagcctccatgcagcaccattcaggtctg
ccctggagagcagcccagcagacccggccacgctcagtgaggacgaagcgcgcctcctgctggctgcactggtgcaggactatgtg
cagatgaaggccagtgagctggagcaggagcaagagagagagggctccagcctggacagccccagatctaagcggtactgcgcc
actgttcattgccaggactgtccttacgaacctgatccaccaaacacagttccaacttcctgtgaagctaaagaaggagaatgtattg
atagcagctgtggcacctgcacgagagacatactatcagatggactgtgtgaaaataaaccaggaaaaacatgttgccgaatgtg
```

-continued

```
tcagtatgtaattgaatgcagagtagaggccgcaggatggtttagaacattctatggaaagagattccagttccaggaacctggtac atacgtgttgggtcaaggaaccaagggcggcgactggaaggtgtccatcaccctggagaacctggatggaaccaaggggcgctgt gctgaccaagacaagactggaagtggctggagacatcattgacatcgctcaagctactgagaatcccatcactgtaaacggtgga gctgaccctatcatcgccaacccgtacaccatcggcgaggtcaccatcgctgttgttgagatgccaggcttcaacatcaccgtcattg agttcttcaaactgatcgtgatcgacatcctcggaggaagatctgtaagaatcgcccagacacagcaaacaaaggaatgatctct ggcctctgtggagatcttaaaatgatggaagatacagacttcacttcagatccagaacaactcgctattcagcctaagatcaaccag gagtttgacggttgtccactctatggaaatcctgatgacgttgcatactgcaaaggtcttctggagccgtacaaggacagctgccgc aaccccatcaacttctactactacaccatctcctgcgccttcgcccgctgtatgggtggagacgagcgagcctcacacgtgctgcttg actacagggagacgtgcgctgctcccgaaactagaggaacctgcgttttgtctggacatactttctacgatacatttgacaaagcaa gataccaattccagggtccctgcaaggagattcttatggccgccgactgtttctggaacacttgggatgtgaaggtttcacacagga atgttgactcttacactgaagtagagaaagtacgaatcaggaaacaatcgactgtagtagaactcattgttgatggaaaacagattc tggttggaggagaagccgtgtccgtcccgtacagctctcagaacacttccatctactggcaagatggtgacatactgactacagcca tcctacctgaagctctggtggtcaagttcaacttcaagcaactgctcgtcgtacatattagagatccattcgatggtaagacttgcggt atttgcggtaactacaaccaggatttcagtgatgattcttttgatgctgaaggagcctgtgatctgaccccaacccaccgggatgca ccgaagaacagaaacctgaagctgaacgactctgcaatagtctcttcgccggtcaaagtgatcttgatcagaaatgtaacgtgtgc cacaagcctgaccgtgtcgaacgatgcatgtacgagtattgcctgaggggacaacagggtttctgtgaccacgcatgggagttcaa gaaagaatgctacataaagcatggagacaccctagaagtaccagatgaatgcaaaaagcggtgcggtaatctgagtacttgcatg ctgggcacatacacgcaggacttcaacaagtttcacacgttcccccaaactgcaattggggttggagcacctggaaagaaaagggatat gtccagcgacttggagagagaccatcgccctcatgttagcatgcccagaatgccaactaa
```

Due to the redundancy of the genetic code, any fusion protein of the present invention could be specified by any number of nucleic acid sequences in which synonymous base changes have been incorporated. Therefore, the nucleic acid sequences listed should be taken as case examples of one such instance for each propeptide-luciferase fusion protein, rather than the only tolerated nucleic acid sequence. The amino acid sequence of each construct ultimately determines the function of the fusion protein, though many possible nucleic acid sequences can specify each the sequence of each peptide.

The nucleic acid sequences of SEQ ID NOs: 139-330 can be introduced into cells for expression. After transcription of these sequences into RNA and subsequent translation into a peptide, the peptide is processed. For example, for those propeptides of the present invention in which the mature peptide is secreted, cleavage will occur at the cleavage sites by the appropriate protease, thereby freeing the bioluminescent protein from the mature peptide. Then, both the bioluminescent protein and the mature peptide are secreted from the cell simultaneously. In other embodiments, for those propeptides of the present invention in which the mature peptide is a transmembrane protein expressed at the cell surface, the cleavage occurs at the cleavage sites before or after the mature peptide is expressed on the cell surface. The sequences outlined in SEQ ID NO: 139 through SEQ ID NO: 330 encode an amino acid sequence, or a propeptide-luciferase fusion protein. Exemplary fusion proteins encoded by SEQ ID NO: 139-204 are listed below by example, and are not to be construed as limiting the present invention to the fusion peptides disclosed below. One of ordinary skill in the art would readily be able to determine the amino acid sequences of any of SEQ ID NO: 139-330.

```
Proamylin-luciferase Mouse (amino acid sequence)
                                                        (SEQ ID NO: 331)
MMCISKLPAVLLILSVALNHLRATPVRSGSNPQMDKRKCNTATCATQRLANFLVRSSNN

LGPVLPPTNVGSNTYGKRNAKPTENNEDFNIVAVASNFATTDLDADRGKLPGKKLPLEV

LKEMEANARKAGCTRGCLICLSHIKCTPKMKKFIPGRCHTYEGDKESAQGGIGEAIVDIP

EIPGFKDLEPMEQFIAQVDLCVDCTTGCLKGLANVQCSDLLKKWLPQRCATFASKIQGQ

VDKIKGAGGDKRNAAGDPNRESLDFLLV

Proamylin-luciferase Human (amino acid sequence)
                                                        (SEQ ID NO: 332)
MGILKLQVFLIVLSVALNHLKATPIESHQVEKRKCNTATCATQRLANFLVHSSNNFGAIL

SSTNVGSNTYGKRNAKPTENNEDFNIVAVASNFATTDLDADRGKLPGKKLPLEVLKEME

ANARKAGCTRGCLICLSHIKCTPKMKKFIPGRCHTYEGDKESAQGGIGEAIVDIPEIPGFK
```

```
DLEPMEQFIAQVDLCVDCTTGCLKGLANVQCSDLLKKWLPQRCATFASKIQGQVDKIKG

AGGDKRNAVEVLKREPLNYLPL

Proinsulin-luciferase Mouse (amino acid sequence)
                                                         (SEQ ID NO: 333)
MALWMRFLPLLALLFLWESHPTQAFVKQHLCGSHLVEALYLVCGERGFFYTPMSRREV

EDPQVAQLELGGGPGAGDLQTLALEVAQQKRKPTENNEDFNIVAVASNFATTDLDADR

GKLPGKKLPLEVLKEMEANARKAGCTRGCLICLSHIKCTPKMKKFIPGRCHTYEGDKES

AQGGIGEAIVDIPEIPGFKDLEPMEQFIAQVDLCVDCTTGCLKGLANVQCSDLLKKWLPQ

RCATFASKIQGQVDKIKGAGGDKRGIVDQCCTSICSLYQLENYCN

Proinsulin-luciferase Human (amino acid sequence)
                                                         (SEQ ID NO: 334)
MALWMRLLPLLALLALWGPDPAAAFVNQHLCGSHLVEALYLVCGERGFFYTPKTRREA

EDLQVGQVELGGGPGAGSLQPLALEGSLQKRKPTENNEDFNIVAVASNFATTDLDADRG

KLPGKKLPLEVLKEMEANARKAGCTRGCLICLSHIKCTPKMKKFIPGRCHTYEGDKESA

QGGIGEAIVDIPEIPGFKDLEPMEQFIAQVDLCVDCTTGCLKGLANVQCSDLLKKWLPQR

CATFASKIQGQVDKIKGAGGDKRGIVEQCCTSICSLYQLENYCN

Proglucagon (includes GRPP, glucagon, GLP-1, GLP-2) Mouse (amino
acid sequence)
                                                         (SEQ ID NO: 335)
MKTIYFVAGLLIMLVQGSWQHALQDTEENPRSFPASQTEAHEDPDEMNEDKRHSQGTFT

SDYSKYLDSRRAQDFVQWLMNTKRNRNNIAKRHDEFERHAEGTFTSDVSSYLEGQAAK

EFIAWLVKGRGRRDFPEEVAIAEELGRKRRKPTENNEDFNIVAVASNFATTDLDADRGK

LPGKKLPLEVLKEMEANARKAGCTRGCLICLSHIKCTPKMKKFIPGRCHTYEGDKESAQ

GGIGEAIVDIPEIPGFKDLEPMEQFIAQVDLCVDCTTGCLKGLANVQCSDLLKKWLPQRC

ATFASKIQGQVDKIKGAGGDKRGRRHADGSFSDEMSTILDNLATRDFINWLIQTKITDKK

Proglucagon (includes GRPP, glucagon, GLP-1, GLP-2) Human (amino
acid sequence)
                                                         (SEQ ID NO: 336)
MKSIYFVAGLFVMLVQGSWQRSLQDTEEKSRSFSASQADPLSDPDQMNEDKRHSQGTFT

SDYSKYLDSRRAQDFVQWLMNTKRNRNNIAKRHDEFERHAEGTFTSDVSSYLEGQAAK

EFIAWLVKGRGRRDFPEEVAIVEELGRKRRKPTENNEDFNIVAVASNFATTDLDADRGK

LPGKKLPLEVLKEMEANARKAGCTRGCLICLSHIKCTPKMKKFIPGRCHTYEGDKESAQ

GGIGEAIVDIPEIPGFKDLEPMEQFIAQVDLCVDCTTGCLKGLANVQCSDLLKKWLPQRC

ATFASKIQGQVDKIKGAGGDKRGRRHADGSFSDEMNTILDNLAARDFINWLIQTKITDR

K

Peptide YY Mouse (amino acid sequence)
                                                         (SEQ ID NO: 337)
MVAVRRPWPVTVAMLLILLACLGALVDAYPAKPEAPGEDASPEELSRYYASLRHYLNL

VTRQRYGKRKPTENNEDFNIVAVASNFATTDLDADRGKLPGKKLPLEVLKEMEANARK

AGCTRGCLICLSHIKCTPKMKKFIPGRCHTYEGDKESAQGGIGEAIVDIPEIPGFKDLEPME

QFIAQVDLCVDCTTGCLKGLANVQCSDLLKKWLPQRCATFASKIQGQVDKIKGAGGDK

RRDVPAALFSKLLFTDDSDSENLPFRPEGLDQW

Peptide YY Human (amino acid sequence)
                                                         (SEQ ID NO: 338)
MVFVRRPWPALTTVLLALLVCLGALVDAYPIKPEAPGEDASPEELNRYYASLRHYLNLV

TRQRYGKRKPTENNEDFNIVAVASNFATTDLDADRGKLPGKKLPLEVLKEMEANARKA

GCTRGCLICLSHIKCTPKMKKFIPGRCHTYEGDKESAQGGIGEAIVDIPEIPGFKDLEPMEQ
```

-continued

FIAQVDLCVDCTTGCLKGLANVQCSDLLKKWLPQRCATFASKIQGQVDKIKGAGGDKR

RDGPDTLLSKTFFPDGEDRPVRSRSEGPDLW

Neuropeptide Y Mouse (amino acid sequence)
(SEQ ID NO: 339)
MLGNKRMGLCGLTLALSLLVCLGILAEGYPSKPDNPGEDAPAEDMARYYSALRHYINLI

TRQRYGKRKPTENNEDFNIVAVASNFATTDLDADRGKLPGKKLPLEVLKEMEANARKA

GCTRGCLICLSHIKCTPKMKKFIPGRCHTYEGDKESAQGGIGEAIVDIPEIPGFKDLEPMEQ

FIAQVDLCVDCTTGCLKGLANVQCSDLLKKWLPQRCATFASKIQGQVDKIKGAGGDKR

RSSPETLISDLLMKESTENAPRTRLEDPSMW

Neuropeptide Y Human (amino acid sequence)
(SEQ ID NO: 340)
MLGNKRLGLSGLTLALSLLVCLGALAEAYPSKPDNPGEDAPAEDMARYYSALRHYINLI

TRQRYGKRKPTENNEDFNIVAVASNFATTDLDADRGKLPGKKLPLEVLKEMEANARKA

GCTRGCLICLSHIKCTPKMKKFIPGRCHTYEGDKESAQGGIGEAIVDIPEIPGFKDLEPMEQ

FIAQVDLCVDCTTGCLKGLANVQCSDLLKKWLPQRCATFASKIQGQVDKIKGAGGDKR

RSSPETLISDLLMRESTENVPRTRLEDPAMW

Pancreatic polypeptide Mouse (amino acid sequence)
(SEQ ID NO: 341)
MAVAYCCLSLFLVSTWVALLLQPLQGTWGAPLEPMYPGDYATPEQMAQYETQLRRYIN

TLTRPRYGKRKPTENNEDFNIVAVASNFATTDLDADRGKLPGKKLPLEVLKEMEANARK

AGCTRGCLICLSHIKCTPKMKKFIPGRCHTYEGDKESAQGGIGEAIVDIPEIPGFKDLEPME

QFIAQVDLCVDCTTGCLKGLANVQCSDLLKKWLPQRCATFASKIQGQVDKIKGAGGDK

RRAEEENTGGLPGVQLSPCTSPPVGLIPCSAPWS

Pancreatic polypeptide Human (amino acid sequence)
(SEQ ID NO: 342)
MAAARLCLSLLLLSTCVALLLQPLLGAQGAPLEPVYPGDNATPEQMAQYAADLRRYIN

MLTRPRYGKRKPTENNEDFNIVAVASNFATTDLDADRGKLPGKKLPLEVLKEMEANAR

KAGCTRGCLICLSHIKCTPKMKKFIPGRCHTYEGDKESAQGGIGEAIVDIPEIPGFKDLEP

MEQFIAQVDLCVDCTTGCLKGLANVQCSDLLKKWLPQRCATFASKIQGQVDKIKGAGG

DKRRHKEDTLAFSEWGSPHAAVPRELSPLDL

Somatostatin Mouse (amino acid sequence)
(SEQ ID NO: 343)
MLSCRLQCALAALCIVALGGVTGAPSDPRLRQFLQKSLAAATGKQELAKYFLAELRKK

PTENNEDFNIVAVASNFATTDLDADRGKLPGKKLPLEVLKEMEANARKAGCTRGCLICL

SHIKCTPKMKKFIPGRCHTYEGDKESAQGGIGEAIVDIPEIPGFKDLEPMEQFIAQVDLCV

DCTTGCLKGLANVQCSDLLKKWLPQRCATFASKIQGQVDKIKGAGGDRKLSEPNQTEN

DALEPEDLPQAAEQDEMRLELQRSANSNPAMAPRERKAGCKNFFWKTFTSC

Somatostatin Human (amino acid sequence)
(SEQ ID NO: 345)
MLSCRLQCALAALSIVALGCVTGAPSDPRLRQFLQKSLAAAAGKQELAKYFLAELRKK

PTENNEDFNIVAVASNFATTDLDADRGKLPGKKLPLEVLKEMEANARKAGCTRGCLICL

SHIKCTPKMKKFIPGRCHTYEGDKESAQGGIGEAIVDIPEIPGFKDLEPMEQFIAQVDLCV

DCTTGCLKGLANVQCSDLLKKWLPQRCATFASKIQGQVDKIKGAGGDRKLSEPNQTEN

DALEPEDLSQAAEQDEMRLELQRSANSNPAMAPRERKAGCKNFFWKTFTSC

GHRH Mouse (amino acid sequence)
(SEQ ID NO: 346)
MLLWVLFVILILTSGSHCSLPPSPPFRMQRHVDAIFTTNYRKLLSQLYARKVIQDIMNKQ

GERIQEQRARLSRQEDSMWTEDKQMTLESIRRKPTENNEDFNIVAVASNFATTDLDADR

GKLPGKKLPLEVLKEMEANARKAGCTRGCLICLSHIKCTPKMKKFIPGRCHTYEGDKES

AQGGIGEAIVDIPEIPGFKDLEPMEQFIAQVDLCVDCTTGCLKGLANVQCSDLLKKWLPQ

RCATFASKIQGQVDKIKGAGGDRRLQGFPRMKPSADA

GHRH Human (amino acid sequence)
(SEQ ID NO: 347)
MPLWVFFFVILTLSNSSHCSPPPPLTLRMRRYADAIFTNSYRKVLGQLSARKLLQDIMSR

QQGESNQERGARARLGRQVDSMWAEQKQMELESILVALRRKPTENNEDFNIVAVASNF

ATTDLDADRGKLPGKKLPLEVLKEMEANARKAGCTRGCLICLSHIKCTPKMKKFIPGRC

HTYEGDKESAQGGIGEAIVDIPEIPGFKDLEPMEQPIAQVDLCVDCTTGCLKGLANVQCS

DLLKKWLPQRCATFASKIQGQVDKIKGAGGDRRLQKHRNSQG

POMC (ACTH, MSH) Mouse (amino acid sequence)
(SEQ ID NO: 348)
MPRFCYSRSGALLLALLLQTSIDVWSWCLESSQCQDLTTESNLLACIRACKLDLSLETPV

FPGNGDEQPLTENPRKYVMGHFRWDRFGPRNSSAGSAAQRRAEEEAVWGDGSPEPSP

REGKRKPTENNEDFNIVAVASNFATTDLDADRGKLPGKKLPLEVLKEMEANARKAGCT

RGCLICLSHIKCTPKMKKFIPGRCHTYEGDKESAQGGIGEAIVDIPEIPGFKDLEPMEQFIA

QVDLCVDCTTGCLKGLANVQCSDLLKKWLPQRCATFASKIQGQVDKIKGAGGDKRSYS

MEHFRWGKPVGKKRRPVKVYPNVAENESAEAFPLEFKRELEGERPLGLEQVLESDAEK

DDGPYRVEHFRWSNPPKDKRYGGFMTSEKSQTPLVTLFKNAIIKNAHKKGQ

POMC (ACTH, MSH) Human (amino acid sequence)
(SEQ ID NO: 349)
MPRSCCSRSGALLLALLLQASMEVRGWCLESSQCQDLTTESNLLECIRACKPDLSAETPM

FPGNGDEQPLTENPRKYVMGHFRWDRFGRRNSSSSGSSGAGQKREDVSAGEDCGPLPE

GGPEPRSDGAKPGPREGKRKPTENNEDFNIVAVASNFATTDLDADRGKLPGKKLPLEVL

KEMEANARKAGCTRGCLICLSHIKCTPKMKKFIPGRCHTYEGDKESAQGGIGEAIVDIPEI

PGFKDLEPMEQFIAQVDLCVDCTTGCLKGLANVQCSDLLKKWLPQRCATFASKIQGQV

DKIKGAGGDKRSYSMEHFRWGKPVGKKRRPVKVYPNGAEDESAEAFPLEFKRELTGQR

LREGDGPDGPADDGAGAQADLEHSLLVAAEKKDEGPYRMEHFRWGSPPKDKRYGGFM

TSEKSQTPLVTLFKNAIIKNAYKKGE

Oxytocin Mouse (amino acid sequence)
(SEQ ID NO: 350)
MACPSLACCLLGLLALTSACYIQNCPLGGKRKPTENNEDFNIVAVASNFATTDLDADRG

KLPGKKLPLEVLKEMEANARKAGCTRGCLICLSHIKCTPKMKKFIPGRCHTYEGDKESA

QGGIGEAIVDIPEIPGFKDLEPMEQFIAQVDLCVDCTTGCLKGLANVQCSDLLKKWLPQR

CATFASKIQGQVDKIKGAGGDKRAVLDLDMRKCLPCGPGGKGRCFGPSICCADELGCFV

GTAEALRCQEENYLPSPCQSGQKPCGSGGRCAATGICCSPDGCRTDPACDPESAFSER

Oxytocin Human (amino acid sequence)
(SEQ ID NO: 351)
MAGPSLACCLLGLLALTSACYIQNCPLGGKRKPTENNEDFNIVAVASNFATTDLDADRG

KLPGKKLPLEVLKEMEANARKAGCTRGCLICLSHIKCTPKMKKFIPGRCHTYEGDKESA

QGGIGEAIVDIPEIPGFKDLEPMEQFIAQVDLCVDCTTGCLKGLANVQCSDLLKKWLPQR

CATFASKIQGQVDKIKGAGGDKRAAPDLDVRKCLPCGPGGKGRCFGPNICCAEELGCFV

GTAEALRCQEENYLPSPCQSGQKACGSGGRCAVLGLCCSPDGCHADPACDAEATFSQR

Vasopressin-Neurophysin-2 Mouse (amino acid sequence)
(SEQ ID NO: 352)
MLARMLNTTLSACFLSLLAFSSACYFQNCPRGGKRKPTENNEDFNIVAVASNFATTDLD

ADRGKLPGKKLPLEVLKEMEANARKAGCTRGCLICLSHIKCTPKMKKFIPGRCHTYEGD

KESAQGGIGEAIVDIPEIPGFKDLEPMEQFIAQVDLCVDCTTGCLKGLANVQCSDLLKKW

LPQRCATFASKIQGQVDKIKGAGGDKRAISDMELRQCLPCGPGGKGRCFGPSICCADELG

CFVGTAEALRCQEENYLPSPCQSGQKPCGSGGRCAAVGICCSDESCVAEPECHDGFFRLT

RAREPSNATQLDGPARALLLRLVQLAGTRESVDSAKPRVY

Vasopressin-Neurophysin-2 Human (amino acid sequence)
(SEQ ID NO: 353)
MPDTMLPACFLGLLAFSSACYFQNCPRGGKRKPTENNEDFNIVAVASNFATTDLDADRG

KLPGKKLPLEVLKEMEANARKAGCTRGCLICLSHIKCTPKMKKFIPGRCHTYEGDKESA

QGGIGEAIVDIPEIPGFKDLEPMEQFIAQVDLCVDCTTGCLKGLANVQCSDLLKKWLPQR

CATFASKIQGQVDKIKGAGGDKRAMSDLELRQCLPCGPGGKGRCFGPSICCADELGCFV

GTAEALRCQEENYLPSPCQSGQKACGSGGRCAAFGVCCNDESCVTEPECREGFHRRARA

SDRSNATQLDGPAGALLLRLVQLAGAPEPFEPAQPDAY

Gonadotropin-releasing hormone (GnRH) Mouse (amino acid sequence)
(SEQ ID NO: 354)
MILKLMAGILLLTVCLEGCSSQHWSYGLRPGGKRKPTENNEDFNIVAVASNFATTDLDA

DRGKLPGKKLPLEVLKEMEANARKAGCTRGCLICLSHIKCTPKMKKFIPGRCHTYEGDK

ESAQGGIGEAIVDIPEIPGFKDLEPMEQFIAQVDLCVDCTTGCLKGLANVQCSDLLKKWL

PQRCATFASKIQGQVDKIKGAGGDKRNTEHLVESFQEMGKEVDQMAEPQHFECTVHWP

RSPLRDLRGALESLIEEEARQKKM

Gonadotropin-releasing hormone (GnRH) Human (amino acid sequence)
(SEQ ID NO: 355)
MKPIQKLLAGLILLTWCVEGCSSQHWSYGLRPGGKRKPTENNEDFNIVAVASNFATTDL

DADRGKLPGKKLPLEVLKEMEANARKAGCTRGCLICLSHIKCTPKMKKFIPGRCHTYEG

DKESAQGGIGEAIVDIPEIPGFKDLEPMEQFIAQVDLCVDCTTGCLKGLANVQCSDLLKK

WLPQRCATFASKIQGQVDKIKGAGGDKRDAENLIDSFQEIVKEVGQLAETQRFECTTHQ

PRSPLRDLKGALESLIEEETGQKKI

Thyroid-stimulating hormone, beta subunit (TSHB) Mouse (amino acid sequence)
(SEQ ID NO: 356)
MSAAVLLSVLFALACGQAASFCIPTEYTMYVDRRECAYCLTINTTICAGYCMTRDINGK

LFLPKYALSQDVCTYRDFIYRTVEIPGCPHHVTPYFSFPVAISCKCGKCNTDNSDCIHEAV

RTNYCTKPQSFYLKPTENNEDFNIVAVASNFATTDLDADRGKLPGKKLPLEVLKEMEAN

ARKAGCTRGCLICLSHIKCTPKMKKFIPGRCHTYEGDKESAQGGIGEAIVDIPEIPGFKDL

EPMEQFIAQVDLCVDCTTGCLKGLANVQCSDLLKKWLPQRCATFASKIQGQVDKIKGA

GGDYLGGFSV

Thyroid-stimulating hormone, beta subunit (TSHB) Human (amino acid sequence)
(SEQ ID NO: 334)
MTALFLMSMLFGLTCGQAMSFCIPTEYTMHIERRECAYCLTINTTICAGYCMTRDINGKL

FLPKYALSQDVCTYRDFIYRTVEIPGCPLHVAPYFSYPVALSCKCGKCNTDYSDCIHEAIK

TNYCTKPQKSYLKPTENNEDFNIVAVASNFATTDLDADRGKLPGKKLPLEVLKEMEANA

RKAGCTRGCLICLSHIKCTPKMKKFIPGRCHTYEGDKESAQGGIGEAIVDIPEIPGFKDLEP

MEQFIAQVDLCVDCTTGCLKGLANVQCSDLLKKWLPQRCATFASKIQGQVDKIKGAGG

DYLVGFSV

Cortisol-releasing factor (CRF) Mouse (amino acid sequence)
(SEQ ID NO: 357)
MRLRLLVSAGMLLVALSSCLPCRALLSRGSVPRAPRAPQPLNFLQPEQPQQPQPVLIRMG

EEYFLRLGNLNRSPAARLSPNSTPLTAGRGSRPSHDQAAANFFRVLLQQLQMPQRSLDSR

AEPAERGAEDALGGHQGALERERRKPTENNEDFNIVAVASNFATTDLDADRGKLPGKK

LPLEVLKEMEANARKAGCTRGCLICLSHIKCTPKMKKFIPGRCHTYEGDKESAQGGIGEA

IVDIPEIPGFKDLEPMEQFIAQVDLCVDCTTGCLKGLANVQCSDLLKKWLPQRCATFASK

IQGQVDKIKGAGGDRRSEEPPISLDLTFHLLREVLEMARAEQLAQQAHSNRKLMEIIGK

Cortisol-releasing factor (CRF) Human (amino acid sequence)
(SEQ ID NO: 358)
MRLPLLVSAGVLLVALLPCPPCRALLSRGPVPGARQAPQHPQPLDFFQPPPQ

SEQPQQPQARPVLLRMGEEYFLRLGNLNKSPAAPLSPASSLLAGGSGSRPSPEQATANFF

RVLLQQLLLPRRSLDSPAALAERGARNALGGHQEAPERERRKPTENNEDFNIVAVASNF

ATTDLDADRGKLPGKKLPLEVLKEMEANARKAGCTRGCLICLSHIKCTPKMKKFIPGRC

HTYEGDKESAQGGIGEAIVDIPEIPGFKDLEPMEQPIAQVDLCVDCTTGCLKGLANVQCS

DLLKKWLPQRCATFASKIQGQVDKIKGAGGDRRSEEPPISLDLTFHLLREVLEMARAEQL

AQQAHSNRKLMEIIGK

Atrial natriuretic peptide (ANP) Mouse (amino acid sequence)
(SEQ ID NO: 359)
MGSFSITLGFFLVLAFWLPGHIGANPVYSAV SNTDLMDFKNLLDHLEEKMPVEDEVMPP

QALSEQTEEAGAALSSLPEVPPWTGEVNPPLRDGSALGRSPWDPSDRSALLKSKLRALLA

GPRSKPTENNEDFNIVAVASNFATTDLDADRGKLPGKKLPLEVLKEMEANARKAGCTR

GCLICLSHIKCTPKMKKFIPGRCHTYEGDKESAQGGIGEAIVDIPEIPGFKDLEPMEQFIAQ

VDLCVDCTTGCLKGLANVQCSDLLKKWLPQRCATFASKIQGQVDKIKGAGGDRSLRRS

SCFGGRIDRIGAQSGLGCNSFRYRR

Atrial natriuretic peptide (ANP) Human (amino acid sequence)
(SEQ ID NO: 360)
MSSFSTTTVSFLLLLAFQLLGQTRANPMYNAVSNADLMDFKNLLDHLEEKMPLEDEVVP

PQVLSEPNEEAGAALSPLPEVPPWTGEVSPAQRDGGALGRGPWDSSDRSALLKSKLRAL

LTAPRSKPTENNEDFNIVAVASNFATTDLDADRGKLPGKKLPLEVLKEMEANARKAGCT

RGCLICLSHIKCTPKMKKFIPGRCHTYEGDKESAQGGIGEAIVDIPEIPGFKDLEPMEQFIA

QVDLCVDCTTGCLKGLANVQCSDLLKKWLPQRCATFASKIQGQVDKIKGAGGDRSLRR

SSCFGGRMDRIGAQSGLGCNSFRY

Brain natriuretic peptide (BNP) Human (amino acid sequence)
(SEQ ID NO: 361)
MDPQTAPSRALLLLLFLHLAFLGGRSHPLGSPGSASDLETSGLQEQRNHLQGKLSELQVE

QTSLEPLQESPRPTGVWKSREVATEGIRGHRKMVLYTLRAPRSKPTENNEDFNIVAVASN

FATTDLDADRGKLPGKKLPLEVLKEMEANARKAGCTRGCLICLSHIKCTPKMKKFIPGR

CHTYEGDKESAQGGIGEAIVDIPEIPGFKDLEPMEQFIAQVDLCVDCTTGCLKGLANVQC

SDLLKKWLPQRCATFASKIQGQVDKIKGAGGDRSRSPKMVQGSGCFGRKMDRISSSSGL

GCKVLRRH

Renin Mouse (amino acid sequence)
(SEQ ID NO: 362)
MDRRRMPLWALLLLWSPCTFSLPTRTATFERIPLKKMPSVREILEERGVDMTRLSAEWG

VFTKRKPTENNEDFNIVAVASNFATTDLDADRGKLPGKKLPLEVLKEMEANARKAGCT

RGCLICLSHIKCTPKMKKFIPGRCHTYEGDKESAQGGIGEAIVDIPEIPGFKDLEPMEQFIA

QVDLCVDCTTGCLKGLANVQCSDLLKKWLPQRCATFASKIQGQVDKIKGAGGDKRPSL

TNLTSPVVLTNYLNTQYYGEIGIGTPPQTFKVIFDTGSANLWVPSTKCSRLYLACGIHSLY

-continued

ESSDSSSYMENGSDFTIHYGSGRVKGFLSQDSVTVGGITVTQTFGEVTELPLIPFMLAKFD

GVLGMGFPAQAVGGVTPVFDHILSQGVLKEEVFSVYYNRGSHLLGGEVVLGGSDPQHY

QGNFHYVSISKTDSWQITMKGVSVGSSTLLCEEGCAVVVDTGSSFISAPTSSLKLIMQAL

GAKEKRIEEYVVNCSQVPTLPDISFDLGGRAYTLSSTDYVLQYPNRRDKLCTLALHAMDI

PPPTGPVWVLGATFIRKFYTEFDRHNNRIGFALAR

Renin Human (amino acid sequence)
(SEQ ID NO: 363)
MDGWRRMPRWGLLLLLWGSCTFGLPTDTTTFKRKPTENNEDFNIVAVASNFATTDLDA

DRGKLPGKKLPLEVLKEMEANARKAGCTRGCLICLSHIKCTPKMKKFIPGRCHTYEGDK

ESAQGGIGEAIVDIPEIPGFKDLEPMEQFIAQVDLCVDCTTGCLKGLANVQCSDLLKKWL

PQRCATFASKIQGQVDKIKGAGGDKRIFLKRMPSIRESLKERGVDMARLGPEWSQPMKR

LTLGNTTSSVILTNYMDTQYYGEIGIGTPPQTFKVVFDTGSSNVWVPSSKCSRLYTACVY

HKLFDASDSSSYKHNGTELTLRYSTGTVSGFLSQDIITVGGITVTQMFGEVTEMPALPFM

LAEFDGVVGMGFIEQAIGRVTPIFDNIISQGVLKEDVFSFYYNRDSENSQSLGGQIVLGGS

DPQHYEGNFHYINLIKTGVWQIQMKGVSVGSSTLLCEDGCLALVDTGASYISGSTSSIEK

LMEALGAKKRLFDYVVKCNEGPTLPDISFHLGGKEYTLTSADYVFQESYSSKKLCTLAIH

AMDIPPPTGPTWALGATFIRKFYTEFDRRNNRIGFALAR

Galanin Mouse (amino acid sequence)
(SEQ ID NO: 364)
MARGSVILLGWLLLVVTLSATLGLGMPAKEKRGKPTENNEDFNIVAVASNFATTDLDA

DRGKLPGKKLPLEVLKEMEANARKAGCTRGCLICLSHIKCTPKMKKFIPGRCHTYEGDK

ESAQGGIGEAIVDIPEIPGFKDLEPMEQFIAQVDLCVDCTTGCLKGLANVQCSDLLKKWL

PQRCATFASKIQGQVDKIKGAGGDKRGWTLNSAGYLLGPHAIDNHRSFSDKHGLTGKRE

LQLEVEERRPGSVDVPLPESNIVRTIMEFLSFLHLKEAGALDSLPGIPLATSSEDLEKS

Galanin Human (amino acid sequence)
(SEQ ID NO: 365)
MARGSALLLASLLLAAALSASAGLWSPAKEKRGKPTENNEDFNIVAVASNFATTDLAD

RGKLPGKKLPLEVLKEMEANARKAGCTRGCLICLSHIKCTPKMKKFIPGRCHTYEGDKE

SAQGGIGEAIVDIPEIPGFKDLEPMEQFIAQVDLCVDCTTGCLKGLANVQCSDLLKKWLP

QRCATFASKIQGQVDKIKGAGGDKRGWTLNSAGYLLGPHAVGNHRSFSDKNGLTSKRE

LRPEDDMKPGSFDRSIPENNIMRTIIEFLSFLHLKEAGALDRLLDLPAAASSEDIERS

Orexin Mouse (amino acid sequence)
(SEQ ID NO: 366)
MNFPSTKVPWAAVTLLLLLLLPPALLSLGVDAQPLPDCCRQKTCSCRLYELLHGAGNHA

AGILTLGKRRPGPPGLQGRLQRLLQANGNHAAGILTMGRRKPTENNEDFNIVAVASNFA

TTDLDADRGKLPGKKLPLEVLKEMEANARKAGCTRGCLICLSHIKCTPKMKKFIPGRCH

TYEGDKESAQGGIGEAIVDIPEIPGFKDLEPMEQFIAQVDLCVDCTTGCLKGLANVQCSD

LLKKWLPQRCATFASKIQGQVDKIKGAGGDGRRAGAELEPHPCSGRGCPTVTTTALAPR

GGSGV

Orexin Human (amino acid sequence)
(SEQ ID NO: 367)
MNLPSTKVSWAAVTLLLLLLLLPPALLSSGAAAQPLPDCCRQKTCSCRLYELLHGAGNH

AAGILTLGKRRSGPPGLQGRLQRLLQASGNHAAGILTMGRRKPTENNEDFNIVAVASNF

ATTDLDADRGKLPGKKLPLEVLKEMEANARKAGCTRGCLICLSHIKCTPKMKKFIPGRC

HTYEGDKESAQGGIGEAIVDIPEIPGFKDLEPMEQPIAQVDLCVDCTTGCLKGLANVQCS

```
DLLKKWLPQRCATFASKIQGQVDKIKGAGGDGRRAGAEPAPRPCLGRRCSAPAAASVA

PGGQSGI

Ghrelin-Obestatin Mouse (amino acid sequence)
                                                        (SEQ ID NO: 368)
MLSSGTICSLLLLSMLWMDMAMAGSSFLSPEHQKAQQRKESKKPPAKLQPRAKPTENN

EDFNIVAVASNFATTDLDADRGKLPGKKLPLEVLKEMEANARKAGCTRGCLICLSHIKC

TPKMKKFIPGRCHTYEGDKESAQGGIGEAIVDIPEIPGFKDLEPMEQFIAQVDLCVDCTTG

CLKGLANVQCSDLLKKWLPQRCATFASKIQGQVDKIKGAGGDPRALEGWLHPEDRGQA

EETEEELEIRFNAPFDVGIKLSGAQYQQHGRALGKFLQDILWEEVKEAPADK

Ghrelin-Obestatin Human (amino acid sequence)
                                                        (SEQ ID NO: 369)
MPSPGTVCSLLLLGMLWLDLAMAGSSFLSPEHQRVQRKESKKPPAKLQPRAKPTENNED

FNIVAVASNFATTDLDADRGKLPGKKLPLEVLKEMEANARKAGCTRGCLICLSHIKCTP

KMKKFIPGRCHTYEGDKESAQGGIGEAIVDIPEIPGFKDLEPMEQHAQVDLCVDCTTGCL

KGLANVQCSDLLKKWLPQRCATFASKIQGQVDKIKGAGGDPRALAGWLRPEDGGQAE

GAEDELEVRFNAPFDVGIKLSGVQYQQHSQALGKFLQDILWEEAKEAPADK

Cholecystokinin Mouse (amino acid sequence)
                                                        (SEQ ID NO: 370)
MKSGVCLCVVMAVLAAGALAQPVVPAEATDPVEQRAQEAPRRQLRAKPTENNEDFNIV

AVASNFATTDLDADRGKLPGKKLPLEVLKEMEANARKAGCTRGCLICLSHIKCTPKMK

KFIPGRCHTYEGDKESAQGGIGEAIVDIPEIPGFKDLEPMEQFIAQVDLCVDCTTGCLKGL

ANVQCSDLLKKWLPQRCATFASKIQGQVDKIKGAGGDRRQLRAVLRTDGEPRARLGAL

LARYIQQVRKAPSGRMSVLKNLQSLDPSHRISDRDYMGWMDFGRRSAEDYEYPS

Cholecystokinin Human (amino acid sequence)
                                                        (SEQ ID NO: 371)
MNSGVCLCVLMAVLAAGALTQPVPPADPAGSGLQRAEEAPRRQLRVKPTENNEDFNIV

AVASNFATTDLDADRGKLPGKKLPLEVLKEMEANARKAGCTRGCLICLSHIKCTPKMK

KFIPGRCHTYEGDKESAQGGIGEAIVDIPEIPGFKDLEPMEQFIAQVDLCVDCTTGCLKGL

ANVQCSDLLKKWLPQRCATFASKIQGQVDKIKGAGGDRRQLRVSQRTDGESRAHLGAL

LARYIQQARKAPSGRMSIVKNLQNLDPSHRISDRDYMGWMDFGRRSAEEYEYPS

Gastrin Mouse (amino acid sequence)
                                                        (SEQ ID NO: 372)
MPRLCVYMLVLVLALATFSEASWKPRSQLQDASSGPGTNEDLEQRQFNKLGSASHHRR

QLGPQGPQHFIADLSKKQRPRMEEEEEAYGWMDFGRRSKPTENNEDFNIVAVASNFATT

DLDADRGKLPGKKLPLEVLKEMEANARKAGCTRGCLICLSHIKCTPKMKKFIPGRCHTY

EGDKESAQGGIGEAIVDIPEIPGFKDLEPMEQPIAQVDLCVDCTTGCLKGLANVQCSDLL

KKWLPQRCATFASKIQGQVDKIKGAGGDRRSAEEDQ

Gastrin Human (amino acid sequence)
                                                        (SEQ ID NO: 373)
MQRLCVYVLIFALALAAFSEASWKPRSQQPDAPLGTGANRDLELPWLEQQGPASHHRR

QLGPQGPPHLVADPSKKQGPWLEEEEEAYGWMDFGRRSKPTENNEDFNIVAVASNFAT

TDLDADRGKLPGKKLPLEVLKEMEANARKAGCTRGCLICLSHIKCTPKMKKFIPGRCHT

YEGDKESAQGGIGEAIVDIPEIPGFKDLEPMEQFIAQVDLCVDCTTGCLKGLANVQCSDL

LKKWLPQRCATFASKIQGQVDKIKGAGGDRRSAEDEN

Protachykinin-1 (Substance P, Neurokinin A, Neuropeptide K,
Neuropeptide gamma) Mouse (amino acid sequence)
                                                        (SEQ ID NO: 374)
MKILVAVAVFFLVSTQLFAEEIDANDDLNYWSDWSDSDQIKEAMPEPFEHLLQRIARRK
```

```
PTENNEDFNIVAVASNFATTDLDADRGKLPGKKLPLEVLKEMEANARKAGCTRGCLICL

SHIKCTPKMKKFIPGRCHTYEGDKESAQGGIGEAIVDIPEIPGFKDLEPMEQFIAQVDLCV

DCTTGCLKGLANVQCSDLLKKWLPQRCATFASKIQGQVDKIKGAGGDRRPKPQQFFGL

MGKRDADSSVEKQVALLKALYGHGQISHKRHKTDSFVGLMGKRALNSVAYERSAMQN

YERRRK

Protachykinin-1 (Substance P, Neurokinin A, Neuropeptide K,
Neuropeptide gamma) Human (amino acid sequence)
                                                     (SEQ ID NO: 375)
MKILVLAVFFLVSTQLFAEEIGANDDLNYWSDWYDSDQIKEELPEPFEHLLQRIARRKP

TENNEDFNIVAVASNFATTDLDADRGKLPGKKLPLEVLKEMEANARKAGCTRGCLICLS

HIKCTPKMKKFIPGRCHTYEGDKESAQGGIGEAIVDIPEIPGFKDLEPMEQFIAQVDLCVD

CTTGCLKGLANVQCSDLLKKWLPQRCATFASKIQGQVDKIKGAGGDRRPKPQQFFGLM

GKRDADSSIEKQVALLKALYGHGQISHKRHKTDSFVGLMGKRALNSVAYERSAMQNYE

RRR

Proenkephalin-A Mouse (amino acid sequence)
                                                     (SEQ ID NO: 376)
MARFLRLCTWLLALGSCLLATVQAECSQDCAKCSYRLVRPGDINFLACTLECEGQLPSF

KIWETCKDLLQVSRPEFPWDNIDMYKDSSKQDESHLLAKKYGGFMKRYGGFMKKMDE

LYPMEPEEEANGGEILAKRYGGFMKKDADEGDTLANSSDLLKELLGTGDNRAKDSHQQ

ESTNNDEDMSKRYGGFMRSLKRSPQLEDEAKELQKRYGGFMRRKPTENNEDFNIVAVA

SNFATTDLDADRGKLPGKKLPLEVLKEMEANARKAGCTRGCLICLSHIKCTPKMKKFIP

GRCHTYEGDKESAQGGIGEAIVDIPEIPGFKDLEPMEQFIAQVDLCVDCTTGCLKGLANV

QCSDLLKKWLPQRCATFASKIQGQVDKIKGAGGDRRVGRPEWWMDYQKRYGGFLKRF

AESLPSDEEGENYSKEVPEIEKRYGGFMRF

Proenkephalin-A Human (amino acid sequence)
                                                     (SEQ ID NO: 377)
MARFLTLCTWLLLLGPGLLATVRAECSQDCATCSYRLVRPADINFLACVMECEGKLPSL

KIWETCKELLQLSKPELPQDGTSTLRENSKPEESHLLAKRYGGFMKRYGGFMKKMDEL

YPMEPEEEANGSEILAKRYGGFMKKDAEEDDSLANSSDLLKELLETGDNRERSHHQDGS

DNEEEVSKRYGGFMRGLKRSPQLEDEAKELQKRYGGFMRRKPTENNEDFNIVAVASNF

ATTDLDADRGKLPGKKLPLEVLKEMEANARKAGCTRGCLICLSHIKCTPKMKKFIPGRC

HTYEGDKESAQGGIGEAIVDIPEIPGFKDLEPMEQFIAQVDLCVDCTTGCLKGLANVQCS

DLLKKWLPQRCATFASKIQGQVDKIKGAGGDRRVGRPEWWMDYQKRYGGFLKRFAEA

LPSDEEGESYSKEVPEMEKRYGGFMRF

Proenkephalin-B Mouse (amino acid sequence)
                                                     (SEQ ID NO: 378)
MAWSRLMLAACLLVMPSNVMADCLSLCSLCAVRIQDGPRPINPLICSLECQDLVPPSEE

WETCRGFSSFLTLTVSGLRGKDDLEDEVALEEGYSALAKLLEPVLKELEKSRLLTSVPEE

KFRGLSSSFGNGKESELAGADRMNDEAAQAGTLHFNEEDLRKQAKRYGGFLRKYPKRK

PTENNEDFNIVAVASNFATTDLDADRGKLPGKKLPLEVLKEMEANARKAGCTRGCLICL

SHIKCTPKMKKFIPGRCHTYEGDKESAQGGIGEAIVDIPEIPGFKDLEPMEQFIAQVDLCV

DCTTGCLKGLANVQCSDLLKKWLPQRCATFASKIQGQVDKIKGAGGDKRSSEMARDED

GGQDGDQVGHEDLYKRYGGFLRRIRPKLKWDNQKRYGGFLRRQFKVVTRSQENPNTY

SEDLDV
```

Proenkephalin-B Human (amino acid sequence)
(SEQ ID NO: 379)
MAWQGLVLAACLLMFPSTTADCLSRCSLCAVKTQDGPKPINPLICSLQCQAALLPSEEW

ERCQSFLSFFTPSTLGLNDKEDLGSKSVGEGPYSELAKLSGSFLKELEKSKFLPSISTKENT

LSKSLEEKLRGLSDGFREGAESELMRDAQLNDGAMETGTLYLAEEDPKEQVKRKPTEN

NEDFNIVAVASNFATTDLDADRGKLPGKKLPLEVLKEMEANARKAGCTRGCLICLSHIK

CTPKMKKFIPGRCHTYEGDKESAQGGIGEAIVDIPEIPGFKDLEPMEQFIAQVDLCVDCTT

GCLKGLANVQCSDLLKKWLPQRCATFASKIQGQVDKIKGAGGDKRYGGFLRKYPKRSS

EVAGEGDGDSMGHEDLYKRYGGFLRRIRPKLKWDNQKRYGGFLRRQFKVVTRSQEDP

NAYSGELFDA

Insulin-like growth hormone 1 (IGF-1) Mouse (amino acid sequence)
(SEQ ID NO: 380)
MGKISSLPTQLFKICLCDFLKIKIHIMSSSHLFYLALCLLTFTSSTTAGPETLCGAELVDAL

QFVCGPRGFYFNKPTGYGSSIRRKPTENNEDFNIVAVASNFATTDLDADRGKLPGKKLPL

EVLKEMEANARKAGCTRGCLICLSHIKCTPKMKKFIPGRCHTYEGDKESAQGGIGEAIVD

IPEIPGFKDLEPMEQFIAQVDLCVDCTTGCLKGLANVQCSDLLKKWLPQRCATFASKIQG

QVDKIKGAGGDSSIRRAPQTGIVDECCFRSCDLRRLEMYCAPLKPTKAARSIRAQRHTD

MPKTQKSPSLSTNKKTKLQRRRKGSTFEEHK

Insulin-like growth hormone 1 (IGF-1) Human (amino acid sequence)
(SEQ ID NO: 381)
MGKISSLPTQLFKCCFCDFLKVKMHTMSSSHLFYLALCLLTFTSSATAGPETLCGAELVD

ALQFVCGDRGFYFNKPTGYGSSSRRKPTENNEDFNIVAVASNFATTDLDADRGKLPGKK

LPLEVLKEMEANARKAGCTRGCLICLSHIKCTPKMKKFIPGRCHTYEGDKESAQGGIGEA

IVDIPEIPGFKDLEPMEQFIAQVDLCVDCTTGCLKGLANVQCSDLLKKWLPQRCATFASK

IQGQVDKIKGAGGDSSRRAPQTGIVDECCFRSCDLRRLEMYCAPLKPAKSARSVRAQRH

TDMPKTQKYQPPSTNKNTKSQRRKGSTFEERK

Insulin-like growth hormone 2 (IGF-2) Mouse (amino acid sequence)
(SEQ ID NO: 382)
MGGSVAGFQVPMGIPVGKSMLVLLISLAFALCCIAAYGPGETLCGGELVDTLQFVCSDR

GFYFSRPSSRANRRSRGIVEECCFRSCDLALLETYCATPAKSERDKPTENNEDFNIVAVAS

NFATTDLDADRGKLPGKKLPLEVLKEMEANARKAGCTRGCLICLSHIKCTPKMKKFIPG

RCHTYEGDKESAQGGIGEAIVDIPEIPGFKDLEPMEQFIAQVDLCVDCTTGCLKGLANVQ

CSDLLKKWLPQRCATFASKIQGQVDKIKGAGGDERDVSTSQAVLPDDFPRYPVGKFFQY

DTWRQSAGRLRRGLPALLRARRGRMLAKELKEFREAKRHRPLIVLPPKDPAHGGASSE

MSSNHQ

Insulin-like growth hormone 2 (IGF-2) Human (amino acid sequence)
(SEQ ID NO: 383)
MGIPMGKSMLVLLTFLAFASCCIAAYRPSETLCGGELVDTLQFVCGDRGFYFSRPASRVS

RRSRGIVEECCFRSCDLALLETYCATPAKSERDKPTENNEDFNIVAVASNFATTDLDADR

GKLPGKKLPLEVLKEMEANARKAGCTRGCLICLSHIKCTPKMKKFIPGRCHTYEGDKES

AQGGIGEAIVDIPEIPGFKDLEPMEQFIAQVDLCVDCTTGCLKGLANVQCSDLLKKWLPQ

RCATFASKIQGQVDKIKGAGGDERDVSTPPTVLPDNFPRYPVGKFFQYDTWKQSTQRLR

RGLPALLRARRGHVLAKELEAFREAKRHRPLIALPTQDPAHGGAPPEMASNRK

Parathyroid hormone (PTH) Mouse (amino acid sequence)
(SEQ ID NO: 384)
MMSANTVAKVMIIMLAVCLLTQTDGKPVRKRKPTENNEDFNIVAVASNFATTDLDADR

```
GKLPGKKLPLEVLKEMEANARKAGCTRGCLICLSHIKCTPKMKKFIPGRCHTYEGDKES

AQGGIGEAIVDIPEIPGFKDLEPMEQFIAQVDLCVDCTTGCLKGLANVQCSDLLKKWLPQ

RCATFASKIQGQVDKIKGAGGDKRAVSEIQLMHNLGKHLASMERMQWLRRKLQDMHN

FVSLGVQMAARDGSHQKPTKKEENVLVDGNPKSLGEGDKADVDVLVKSKSQ

Parathyroid hormone (PTH) Human (amino acid sequence)
                                                    (SEQ ID NO: 385)
MIPAKDMAKVMIVMLAICFLTKSDGKSVKKRKPTENNEDFNIVAVASNFATTDLDADR

GKLPGKKLPLEVLKEMEANARKAGCTRGCLICLSHIKCTPKMKKFIPGRCHTYEGDKES

AQGGIGEAIVDIPEIPGFKDLEPMEQFIAQVDLCVDCTTGCLKGLANVQCSDLLKKWLPQ

RCATFASKIQGQVDKIKGAGGDKRSVSEIQLMHNLGKHLNSMERVEWLRKKLQDVHNF

VALGAPLAPRDAGSQRPRKKEDNVLVESHEKSLGEADKADVNVLTKAKSQ

Parathyroid hormone-related protein (PTHrP) Mouse (amino acid sequence)
                                                    (SEQ ID NO: 386)
MLRRLVQQWSVLVFLLSYSVPSRGRSVEGLGRRLKRKPTENNEDFNIVAVASNFATTDL

DADRGKLPGKKLPLEVLKEMEANARKAGCTRGCLICLSHIKCTPKMKKFIPGRCHTYEG

DKESAQGGIGEAIVDIPEIPGFKDLEPMEQFIAQVDLCVDCTTGCLKGLANVQCSDLLKK

WLPQRCATFASKIQGQVDKIKGAGGDKRAVSEHQLLHDKGKSIQDLRRRFFLHHLIAEIH

TAEIRATSEVSPNSKPAPNTKNHPVRFGSDDEGRYLTQETNKVETYKEQPLKTPGKKKK

GKPGKRREQEKKKRRTRSAWPSTAASGLLEDPLPHTSRPSLEPSLRTH

Parathyroid hormone-related protein (PTHrP) Human (amino acid sequence)
                                                    (SEQ ID NO: 387)
MQRRLVQQWSVAVFLLSYAVPSCGRSVEGLSRRLKRKPTENNEDFNIVAVASNFATTDL

DADRGKLPGKKLPLEVLKEMEANARKAGCTRGCLICLSHIKCTPKMKKFIPGRCHTYEG

DKESAQGGIGEAIVDIPEIPGFKDLEPMEQFIAQVDLCVDCTTGCLKGLANVQCSDLLKK

WLPQRCATFASKIQGQVDKIKGAGGDKRAVSEHQLLHDKGKSIQDLRRRFFLHHLIAEIH

TAEIRATSEVSPNSKPSPNTKNHPVRFGSDDEGRYLTQETNKVETYKEQPLKTPGKKKKG

KPGKRKEQEKKKRRTRSAWLDSGVTGSGLEGDHLSDTSTTSLELDSRRH

Osteocalcin Mouse (amino acid sequence)
                                                    (SEQ ID NO: 388)
MRTIFLLTLLTLAALCLSDLTDAKPSGPESDKAFMSKQEGNKVVNRLRRKPTENNEDFNI

VAVASNFATTDLDADRGKLPGKKLPLEVLKEMEANARKAGCTRGCLICLSHIKCTPKM

KKFIPGRCHTYEGDKESAQGGIGEAIVDIPEIPGFKDLEPMEQFIAQVDLCVDCTTGCLKG

LANVQCSDLLKKWLPQRCATFASKIQGQVDKIKGAGGDRRYLGASVPSPDPLEPTREQC

ELNPACDELSDQYGLKTAYKRIYGITI

Osteocalcin Human (amino acid sequence)
                                                    (SEQ ID NO: 389)
MRALTLLALLALAALCIAGQAGAKPSGAESSKGAAFVSKQEGSEVVKRPRRKPTENNED

FNIVAVASNFATTDLDADRGKLPGKKLPLEVLKEMEANARKAGCTRGCLICLSHIKCTP

KMKKFIPGRCHTYEGDKESAQGGIGEAIVDIPEIPGFKDLEPMEQHAQVDLCVDCTTGCL

KGLANVQCSDLLKKWLPQRCATFASKIQGQVDKIKGAGGDRRYLYQWLGAPVPYPDPL

EPRREVCELNPDCDELADHIGFQEAYRRFYGPV

Urocortin-3 Mouse (amino acid sequence)
                                                    (SEQ ID NO: 390)
MLMPTYFLLPLLLLLGGPRTSLSHKFYNTGPVFSCLNTALSEVKKNKLEDVPLLSKKSFG

HLPTQDPSGEEDDNQTHLQIKRTFSGAAGGNGAGSTRYRYQSQAQHKGKLYPDKPKSD

RGTKKPTENNEDFNIVAVASNFATTDLDADRGKLPGKKLPLEVLKEMEANARKAGCTR

GCLICLSHIKCTPKMKKFIPGRCHTYEGDKESAQGGIGEAIVDIPEIPGFKDLEPMEQFIAQ
```

```
VDLCVDCTTGCLKGLANVQCSDLLKKWLPQRCATFASKIQGQVDKIKGAGGDRGTKFT

LSLDVPTNIMNILFNIDKAKNLRAKAAANAQLMAQIGKKK

Urocortin-3 Human (amino acid sequence)
                                                        (SEQ ID NO: 391)
MLMPVHFLLLLLLLLGGPRTGLPHKFYKAKPIFSCLNTALSEAEKGQWEDASLLSKRSFH

YLRSRDASSGEEEEGKEKKTFPISGARGGARGTRYRYVSQAQPRGKPRQDTAKSPHRKP

TENNEDFNIVAVASNFATTDLDADRGKLPGKKLPLEVLKEMEANARKAGCTRGCLICLS

HIKCTPKMKKFIPGRCHTYEGDKESAQGGIGEAIVDIPEIPGFKDLEPMEQFIAQVDLCVD

CTTGCLKGLANVQCSDLLKKWLPQRCATFASKIQGQVDKIKGAGGDHRTKFTLSLDVPT

NIMNLLFNIAKAKNLRAQAAANAHLMAQIGRKK

Urocortin-2 Mouse (amino acid sequence)
                                                        (SEQ ID NO: 392)
MMTRWALVVFVVLMLDRILFVPGTPIPTFQLLPQNSLETTPSSVTSESSSGTTTGPSASWS

NSKASPYLDTRVKPTENNEDFNIVAVASNFATTDLDADRGKLPGKKLPLEVLKEMEANA

RKAGCTRGCLICLSHIKCTPKMKKFIPGRCHTYEGDKESAQGGIGEAIVDIPEIPGFKDLEP

MEQFIAQVDLCVDCTTGCLKGLANVQCSDLLKKWLPQRCATFASKIQGQVDKIKGAGG

DTRVILSLDVPIGLLRILLEQARYKAARNQAATNAQILAHVGRR

Urocortin-2 Human (amino acid sequence)
                                                        (SEQ ID NO: 393)
MTRCALLLLMVLMLGRVLVVPVTPIPTFQLRPQNSPQTTPRPAASESPSAAPTWPWAAQ

SHCSPTRHPGSRIKPTENNEDFNIVAVASNFATTDLDADRGKLPGKKLPLEVLKEMEANA

RKAGCTRGCLICLSHIKCTPKMKKFIPGRCHTYEGDKESAQGGIGEAIVDIPEIPGFKDLEP

MEQFIAQVDLCVDCTTGCLKGLANVQCSDLLKKWLPQRCATFASKIQGQVDKIKGAGG

DSRIVLSLDVPIGLLQILLEQARARAAREQATTNARILARVGHC

Urocortin-1 Mouse (amino acid sequence)
                                                        (SEQ ID NO: 394)
MIQRGRATLLVALLLLAQLRPESSQWSPAAAAATGVQDPNLRWSPGVRNQGGGVRALL

LLLAERFPRRAGSEPAGERQRRKPTENNEDFNIVAVASNFATTDLDADRGKLPGKKLPLE

VLKEMEANARKAGCTRGCLICLSHIKCTPKMKKFIPGRCHTYEGDKESAQGGIGEAIVDI

PEIPGFKDLEPMEQFIAQVDLCVDCTTGCLKGLANVQCSDLLKKWLPQRCATFASKIQG

QVDKIKGAGGDRRDDPPLSIDLTFHLLRTLLELARTQSQRERAEQNRIIFDSVGK

Urocortin-1 Human (amino acid sequence)
                                                        (SEQ ID NO: 395)
MRQAGRAALLAALLLLVQLCPGSSQRSPEAAGVQDPSLRWSPGARNQGGGARALLLLL

AERFPRRAGPGRLGLGTAGERPRRKPTENNEDFNIVAVASNFATTDLDADRGKLPGKKL

PLEVLKEMEANARKAGCTRGCLICLSHIKCTPKMKKFIPGRCHTYEGDKESAQGGIGEAI

VDIPEIPGFKDLEPMEQFIAQVDLCVDCTTGCLKGLANVQCSDLLKKWLPQRCATFASKI

QGQVDKIKGAGGDRRDNPSLSIDLTFHLLRTLLELARTQSQRERAEQNRIIFDSVGK
```

Multiplexing Luciferase Reporters for Tracking Multiple Proteins and/or for Normalization The nucleic acid constructs and propeptide-luciferase fusion proteins described herein can be used either in isolation to track the secretion of a single protein, or in a multiplexed format to track the secretion of multiple proteins simultaneously. The nucleic acid constructs and propeptide-luciferase fusion proteins described herein can be used either in isolation to track the expression of a single protein at the cell surface, or in a multiplexed format to track the expression of multiple proteins at the cell surface simultaneously. As *Gaussia* luciferase and *Cypridina* luciferase act on different substrates to create luminescence, one could use a "Propeptide.A—*Gaussia* luciferase" fusion protein to track secretion of Protein.A, and a "Propeptide.B—*Cypridina* luciferase" fusion protein to track secretion of Protein.B, if each fusion protein were expressed in the same cells, or if each were expressed separately but in a mixed pool of cells. The ability to multiplex the luciferase reporters has added advantage and utility in chemical and genetic screening assays. Similarly, one could track the cell surface expression of Protein A and Protein B, as described herein.

For example, one skilled in the art could use the multiplex format for screening compounds that affect inflammation. In this example, two nucleic acid constructs encoding propeptide-luciferase fusion proteins can be utilized, the first comprises a propeptide that is an anti-inflammatory cytokine and the *Gaussia* luciferase and the second comprises a propeptide that is a pro-inflammatory cytokine and the *Cypridina* luciferase. The nucleic acid constructs are introduced into the same cell, or a population of cells, such that each cell expresses both constructs. The cells are contacted by test compounds and the bioluminescence is detected, for example by luminometer. Luminescence resulting from activation of the *Gaussia* or *Cypridina* luciferase indicates that the test compound stimulates anti-inflammatory signaling or pro-inflammatory signaling, respectively. In this manner, more than one biological readout (in this case, mature secreted cytokine) can be detected at one time, granting increased utility to the invention described herein for use in chemical and genetic screens.

In another embodiment, a control luciferase that acts on different substrates to create luminescence from the propeptide-luciferase reporter can be used as an internal reference. For example, as Firefly luciferase acts on a third substrate to produce luminescence, one could use this bioluminescent protein to normalize for expression differences across cells, for example by expressing it constitutively within the cells expressing the propeptide-luciferase fusion reporters described. In such a manner, one could assemble kits to monitor the activity of multiple biologic pathways and/or secreted proteins, with or without normalization to a control luciferase signal, for use in basic science research, as well as chemical and genetic screening projects.

High Throughput Screening Assays

Traditional methods of investigating peptide secretion are time-intensive and expensive. ELISA tests are accurate only within a limited range of detection, and as such, results often need to be verified by using serial dilution assays to verify that the signal detected is within the linear range.

The present invention provides methods that are more efficient, cost-effective, sensitive, accurate, and therefore more amenable to large-scale high throughput chemical and genetic screens than the standard methods known in the art to date. The present invention is highly sensitive and accurate as the detection of the luminescence, for example, by a luminometer, is highly sensitive, requires no dilution, and has a very broad range of signal detection. As an example, up to a thousand-fold dilution of sample still results in a signal within the linear range of the assay.

The present invention contemplates methods for identifying specific modulators, such as chemical compounds or genes, of peptide secretion or cell surface expression using various screening assays known in the art. The present invention also contemplates methods for identifying specific compounds that differentiate a embryonic or iPS stem cell to a mature, or differentiated cell using various screening assays known in the art. For example, the mature or differentiated cell is a hormone-secreting cell, a neuropeptide-secreting cell, a cytokine-secreting cell, or a cell that can no longer differentiate into more than one cell type.

Any screening technique known in the art can be used to screen modulators of peptide secretion or cell surface expression. For example, natural products libraries can be screened using assays of the invention. The present invention contemplates screens for synthetic small molecule agents, chemical compounds, chemical complexes, and salts thereof. Other molecules that can be identified using the screens of the invention include proteins and peptide fragments, peptides, nucleic acids and oligonucleotides, carbohydrates, phospholipids and other lipid derivatives. Other modulators of peptide secretion can also include genes that are involved in regulating the pathways that control hormone secretion. Other modulators of cell surface expression can also include genes that are involved in regulating the pathways that control cell surface expression.

In another aspect, synthetic libraries (Needels et al., Proc. Natl. Acad. Sci. USA 90:10700-4, 1993; Ohlmeyer et al., Proc. Natl. Acad. Sci. USA 90:10922-10926, 1993; Lam et al., International Patent Publication No. WO 92/00252; Kocis et al., International Patent Publication No. WO 9428028) and the like can be used to screen for compounds that modulate peptide secretion.

Test compounds are screened from large libraries of synthetic or natural compounds. Numerous means are currently used for random and directed synthesis of saccharide, peptide, and nucleic acid based compounds. Synthetic compound libraries are commercially available from Maybridge Chemical Co. (Trevillet, Cornwall, UK), Comgenex (Princeton, N.J.), Brandon Associates (Merrimack, N.H.), and Microsource (New Milford, Conn.). A rare chemical library is available from Aldrich (Milwaukee, Wis.). Alternatively, libraries of natural compounds in the form of bacterial, fungal, plant and animal extracts are available from e.g. Pan Laboratories (Bothell, Wash.) or MycoSearch (N.C.), or are readily producible. Additionally, natural and synthetically produced libraries and compounds are readily modified through conventional chemical, physical, and biochemical means (Blondelle et al., Tib Tech, 14:60, 1996).

RNAi and open reading frame (ORF) libraries, such as those of the RNAi Consortium at the Broad Institute, can be used to screen for genes that increase or decrease peptide secretion, or increase or decrease cell surface expression.

The sensitivity and accuracy of the luminescence detection allows for screening at the level of single cell detection. Single cell analysis may be particularly useful in RNAi screens, where pools of RNAi molecules can be tested. For example, a pool of unique short hairpins targeting different genes that each contain an unique "barcode" that designates the target gene, would be introduced to a population of cells that express a prohormone fusion protein of the present invention. The bioluminescence signal and the unique hairpin can be detected using various single cell analysis methods known in the art. For example, the population of cells can be separated and analyzed using various well-, trap-, pattern-, and droplet-based microfluidic devices and platforms. The luminescence signal and the shRNA "barcode" can be determined concurrently or sequentially to identify the genes responsible for modulating hormone secretion.

Once genetic variants that have altered peptide secretion or cell surface expression are identified, additional compound screens can be performed to identify those compounds that reverse or augment the genetic effect.

According to the present invention, a host cell containing a fusion construct between a propeptide and a bioluminescent protein is constructed. Candidate agents are added to in vitro cell cultures of host cells, prepared by known methods in the art, and the activity of the bioluminescent protein is measured within the cellular supernatant. Various in vitro systems can be used to analyze the effects of a new compound on bioluminescent protein expression. For example, light emission is detected by known methods, such as detection with suitable instrumentation (such as a luminometer or CCD camera) in vivo or in vitro, such as in a living cell or intact organism, a cell culture system, a tissue section, or an array. Preferably, the luminescence is detected by luminometer. Preferably, the luminometer is in a plate-reader format.

Vectors and Kits

The present invention also provides a nucleic acid expression vector comprising a nucleic acid sequence encoding a bioluminescent protein, wherein the bioluminescent protein lacks a native signal peptide; a nucleic acid sequence encoding two cleavage sites, wherein the cleavage sites flank the bioluminescent protein such that when the vector is expressed by a cell, the bioluminescent protein is cleaved from the remaining peptide; and at least one insertion site for insertion of a nucleic acid sequence encoding a propeptide such that the inserted nucleic acid sequence is in-frame with the bioluminescent protein. The insertion site is a restriction enzyme site, multiple cloning site containing multiple restriction enzyme sites, or a site recognized by a recombinase. Optionally, the nucleic acid expression vector comprises a promoter, wherein the promoter is operatively linked to the nucleic acid sequence encoding the bioluminescent protein. Optionally, the nucleic acid expression vector comprises a selective marker operatively linked to a second promoter. The selective marker can be an antibiotic resistance gene, drug resistance gene, toxin resistance gene or a cell surface marker.

Alternatively, a nucleic acid expression vector may comprise any nucleic acid construct described herein operatively linked to a promoter and a selective marker operatively linked to a second promoter.

The vectors of the present invention can be expressed in any of the cells described herein.

The present invention further provides a kit. The kit includes any or at least one of the nucleic acid expression vectors described herein, at least one luciferase substrate and instructions for use. The luciferase substrate will be selected according to the nucleic acid expression vector of the kit, such that the luciferase of the expression vector will dictate the luciferase substrate included in the kit. For example, a kit containing a nucleic acid expression vector that encodes *Gaussia* luciferase will also include the *Gaussia* luciferase substrate. For those kits that include more than one nucleic acid expression vector, the corresponding luciferase substrates to each nucleic acid expression vector will also be included in the kit.

The present invention further provides a kit that contains any one of the cells that express a propeptide-luciferase fusion protein as described herein.

Any kit of the present invention further comprises a control nucleic acid construct that encodes a control luciferase or cells expressing the control luciferase for use as an internal control. Importantly, the control luciferase is different from the luciferase(s) of the nucleic acid expression vectors; such that the detected luminescence can be easily distinguished from the luminescence signal of the *Gaussia* and/or *Cypridina* reporters. For example, the control luciferase is Firefly luciferase.

DEFINITIONS

"Compound" as used herein encompasses all types of organic or inorganic molecules, including but not limited to proteins, peptides, polysaccharides, lipids, nucleic acids, small organic molecules, inorganic compounds, and derivatives thereof.

"Polypeptide," "Protein," and "Peptide" are used interchangeably to refer to amino acid chains in which the amino acid residues are linked by covalent peptide bonds. The amino acid chains can be of any length of at least two amino acids, including full-length proteins. Unless otherwise specified, the terms "polypeptide," "protein," and "peptide" also encompass various modified forms thereof, including but not limited to glycosylated forms, phosphorylated forms, etc.

"Test agent" or "Test compound" means a chemical compound, preferably an organic compound, to be tested in the present invention to determine its ability to interact with another chemical compound. Test agents may include various forms of organic compounds, or combinations or conjugates thereof. In one embodiment, the test agents preferably are polypeptides, in which case the test agents are termed "test polypeptides" or "test proteins."

"Fusion construct" refers to a non-naturally occurring hybrid or chimeric construct having two or more distinct portions covalently linked together, each portion being or being derived from a specific molecule. When two or more portions in a fusion construct as defined above are polypeptides and are linked together by peptide bonds, the fusion construct is conveniently referred to as "fusion protein."

"Preprohormone" is the precursor protein to one or more prohormones, which are in turn precursors to peptide hormones. The protein generally consists of the amino acid chain that is created by the hormone secreting cell, before any changes have been made to it. It contains a signal peptide, the hormone(s) itself (themselves), and intervening amino acids. Before the hormone is released from the cell, the signal peptide and other amino acids are removed.

"Prohormone" is a substance that is a precursor to a hormone.

"Propeptide" is a peptide precursor to a mature peptide. In some embodiments, the propeptide is processed to become a mature peptide, i.e. by cleavage and/or transport through the secretory pathway to be either secreted or expressed at the cell surface.

"Peptide hormones" are a class of peptides that are secreted into the blood stream and have endocrine functions in living animals "Light-generating" or "luminescent" includes the property of generating light through a chemical reaction or through the absorption of radiation, including phosphorescence, fluorescence, and bioluminescence.

"Bioluminescent proteins" include any light-generating polypeptides, including fluorescent proteins such as green fluorescent protein (GFP) and luminescent proteins such as luciferase.

"Bioluminescent" molecules or moieties include luminescent substances such as proteins that utilize chemical energy to produce light.

"Fluorescent" molecules or moieties include those that are luminescent via a single electronically excited state, which is of very short duration after removal of the source of radiation. The wavelength of the emitted fluorescence light is longer than that of the exciting illumination (Stokes' Law), because part of the exciting light is converted into heat by the fluorescent molecule.

"Light" includes electromagnetic radiation having a wavelength of between about 300 nm and about 1100 nm, but can be of longer or shorter wavelength.

"Light-generating gene product" includes any protein known to those of ordinary skill in the art to provide a readily detectable source of light when present in stable form. Non-limiting examples include light-generating proteins described in U.S. Pat. Nos. 5,683,888, 5,958,713, and 5,650,135, e.g., ferredoxin IV, green fluorescent protein, red fluorescent protein, yellow fluorescent protein, blue fluorescent protein, the luciferase family (see, e.g., WO 03/016839), and the aequorin family. In a preferred embodiment, the light-generating polypeptide moiety is a protein such as green fluorescent protein, red fluorescent protein, yellow fluorescent protein and blue fluorescent protein. Light-generating gene products include light-generating polypeptide moieties.

"Light-generating fusion protein" or "fusion protein" includes proteins of the invention having a light-generating or luminescent portion, i.e., a light-generating polypeptide such as luciferase and preprohormone.

"Small molecule" includes compositions that have a molecular weight of less than about 5 kD and most preferably less than about 4 kD. Small molecules is, e.g., nucleic acids, peptides, polypeptides, peptidomimetics, carbohydrates, lipids or other organic or inorganic molecules.

"Heterologous gene" includes a gene that has been transfected into a host organism. Typically, a heterologous gene refers to a gene that is not originally derived from the transfected or transformed cells' genomic DNA.

"Recombinant nucleic acid molecules" include nucleic acid sequences not naturally present in the cell, tissue or organism into which they are introduced.

The term "operably linked" relates to the orientation of polynucleotide elements in a functional relationship. Operably linked means that the DNA sequences being linked are generally contiguous and, where necessary to join two protein coding regions, contiguous and in the same reading frame. However, since enhancers generally function when separated from the promoter by several kilobases, some nucleic acids is operably linked but not contiguous.

The terms "polynucleotide" and "nucleic acid molecule" are used interchangeably to refer to polymeric forms of nucleotides of any length. The polynucleotides may contain deoxyribonucleotides, ribonucleotides and/or their analogs. Nucleotides may have any three-dimensional structure, and may perform any function, known or unknown. The term "polynucleotide" includes single-, double-stranded and triple helical molecules. "Oligonucleotide" refers to polynucleotides of between 5 and about 100 nucleotides of single- or double-stranded DNA. Oligonucleotides are also known as oligomers or oligos and are isolated from genes, or chemically synthesized by methods known in the art. A "primer" refers to an oligonucleotide, usually single-stranded, that provides a 3'-hydroxyl end for the initiation of enzyme-mediated nucleic acid synthesis. The following are non-limiting embodiments of polynucleotides: a gene or gene fragment, exons, introns, mRNA, tRNA, rRNA, ribozymes, cDNA, recombinant polynucleotides, branched polynucleotides, plasmids, vectors, isolated DNA of any sequence, isolated RNA of any sequence, nucleic acid probes and primers. A nucleic acid molecule may also comprise modified nucleic acid molecules, such as methylated nucleic acid molecules and nucleic acid molecule analogs. Analogs of purines and pyrimidines are known in the art, and include, but are not limited to, aziridinycytosine, 4-acetylcytosine, 5-fluorouracil, 5-bromouracil, 5-carboxymethylaminomethyl-2-thiouracil, 5-carboxymethylaminomethyluracil, inosine, N6-isopentenyladenine, 1-methyladenine, 1-methylpseudouracil, 1-methylguanine, 1-methylinosine, 2,2-dimethylguanine, 2-methyladenine, 2-methylguanine, 3-methylcytosine, 5-methylcytosine, pseudouracil, 5-pentylnyluracil and 2,6-diaminopurine. The use of uracil as a substitute for thymine in a deoxyribonucleic acid is also considered an analogous form of pyrimidine.

A "fragment" of a polynucleotide is a polynucleotide comprised of at least 9 contiguous nucleotides, preferably at least 15 contiguous nucleotides and more preferably at least 45 nucleotides, of coding or non-coding sequences.

The term "homologous recombination" refers to the exchange of DNA fragments between two DNA molecules or chromatids at the site of homologous nucleotide sequences.

The term "homologous" as used herein denotes a characteristic of a DNA sequence having at least about 70 percent sequence identity as compared to a reference sequence, typically at least about 85 percent sequence identity, preferably at least about 95 percent sequence identity, and more preferably about 98 percent sequence identity, and most preferably about 100 percent sequence identity as compared to a reference sequence. Homology is determined using, for example, a "BLASTN" algorithm. It is understood that homologous sequences can accommodate insertions, deletions and substitutions in the nucleotide sequence. Thus, linear sequences of nucleotides are essentially identical even if some of the nucleotide residues do not precisely correspond or align. The reference sequence is a subset of a larger sequence, such as a portion of a gene or flanking sequence, or a repetitive portion of a chromosome.

The term "transgenic cell" refers to a cell containing within its genome a nucleic acid encoding a preprohormone operably linked to a nucleic acid encoding a bioluminescent protein introduced by the method of gene targeting.

The term "proliferating cell" includes any cell undergoing cell division.

As used herein, the terms "selectable marker" and "positive selection marker" refer to a gene encoding a product that enables only the cells that carry the gene to survive and/or grow under certain conditions. For example, plant and animal cells that express the introduced neomycin resistance (Neo (r)) gene are resistant to the compound G418. Cells that do not carry the Neo (r) gene marker are killed by G418. Other positive selection markers are known to or are within the purview of those of ordinary skill in the art.

A "host cell" includes an individual cell or cell culture that is or has been a recipient for vector(s) or for incorporation of nucleic acid molecules and/or proteins. Host cells include progeny of a single host cell, and the progeny may not necessarily be completely identical (in morphology or in total DNA complement) to the original parent due to natural, accidental, or deliberate mutation. A host cell includes cells transfected with the constructs of the present invention.

The term "modulates" as used herein refers to the decrease, inhibition, reduction, increase, or enhancement of a gene function, expression, or activity.

EXAMPLES

Example 1: General Methods

Cell Culture

MIN6 cells (Miyazaki, J. et al *Endocrinology* 127:126-132 (1990)) were maintained in DMEM with 4.5 g/L glucose, supplemented with 10% heat-inactivated fetal bovine serum and 55 µM beta-mercaptoethanol (Sigma, St. Louis, Mo.). INS-1E cells (Merglen, A et al. *Endocrinology* 145: 667-678 (2004)) were maintained in RPMI with 2 g/L glucose, supplemented with 10% heat-inactivated fetal bovine serum, 1 mM sodium pyruvate, 2 mM L-glutamine, 10 mM HEPES and 55 µM beta-mercaptoethanol (Invitrogen, Grand Island, N.Y.). Cells were grown on standard tissue culture-treated plastic (Becton Dickenson, Waltham, Mass.) and all dissociation steps were performed using TrypLE (Invitrogen).

Prohormone-Luciferase Constructs

The proinsulin-luciferase fusion construct was created by Gibson Assembly in the pUC19 vector (NEB, Ipswich, Mass.) using two gBlocks (IDT, Coralville, Iowa) encoding the protein and Gibson Assembly Master Mix (NEB). Mouse proamylin was subcloned from the vector pT7T3D-PacI (clone MmCD00310704, DF/HCC DNA Resource Core, Boston, Mass.) into the pCI-Neo vector (Promega, Madison, Wis.). *Gaussia* luciferase was amplified from pCMV-GLuc (NEB) using oligonucleotide primers (IDT) designed to exclude the start codon, signal peptide and stop codon, and to add a prohormone convertase 2 site to the c-terminus and flanking BsmI sites. pCI-Neo-proamylin was then digested with BsmI (NEB) and ligated to the BsmI digest of the *Gaussia* luciferase PCR product. The proinsulin-luciferase and proamylin-luciferase fusion constructs were subsequently PCR-amplified with primers to add attB1 and attB2 sites, inserted by BP Clonase II into the Gateway Entry vector pDONR223 (Invitrogen), and then shuttled by LR Clonase II into the Gateway Destination vector pLX304 (David Root lab, Addgene plasmid 25890) (Yang, X. et al. Nat Methods 8:659-661 (2011)). Other prohormone-luciferase constructs, such as the preproglucagon-luciferase construct, were generated in a similar manner.

Lentivirus Production

Lentivirus expressing each prohormone-luciferase fusion protein was produced as described (Yang, X. et al. Nat Methods 8:659-661 (2011)). Briefly, 2 µg of pLX304 expression plasmid containing the fusion construct, 1.8 µg of psPAX2 packaging plasmid (Didier Trono lab, Addgene plasmid 12260), 200 ng of pMD2.G envelope plasmid (Didier Trono lab, Addgene plasmid 12259) and 12 µL TransIT-LT1 (Minis Bio, Madison, Wis.) were used to transfect a 10 cm dish of HEK293T packaging cells (ATCC, Manassas, Va.). Virus was pooled from harvests at 48 and 72 hours and passed through 0.2 µm cellulose acetate filters (VWR, Radnor, Pa.) prior to use.

Virus Infection

MIN6 and INS-1E cells were plated in their respective growth media with the addition of 8 µg/mL polybrene (Sigma). Virus was then added and the cells were spun at 800 g for 1 hour at 30° C. After 24 hours in the presence of virus, the cells were placed in fresh growth media for 24 hours, then selection was performed using 5 µg/mL blasticidin (Invitrogen). Cells were assessed for luciferase localization and secretion after 1 week of antibiotic selection.

Immunofluorescence

Staining of cells was performed as described (Walpita D, et al. *J Biomol Screen* 17:509-518 (2012)). Briefly, cultures were fixed for 15 min at room temperature using 3% paraformaldehyde and washed twice with PBS. Cells were permeabilized for 20 min at room temperature in PBS containing 0.1% saponin and blocked overnight at 4° C. with 2% bovine serum albumin (BSA) in PBS. Primary antibodies to *Gaussia* luciferase (#401P, Nanolight, Pinetop, Ariz.) and insulin (#18510, Sigma) were diluted 1:1000 in antibody dilution buffer (ADB; 1% BSA in PBS) and incubated overnight at 4° C., followed by three washes in ADB. Cultures were then incubated in secondary antibodies (Alexa Fluor-conjugated anti-rabbit and anti-guinea pig; Invitrogen) diluted 1:1000 in ADB for 1 hour at room temperature, followed by five washes with PBS. Images were acquired using a Zeiss Axiovert 200M inverted fluorescent microscope and AxioCam MRm camera (Zeiss, Thornwood, N.Y.).

Secretion Assays

For standard secretion assays, MIN6 and INS-1E cells were plated in 96-well format at a density of $4 \times 10^4$ cells per well in 100 µL of their respective growth media and incubated overnight at 37° C. in 5% $CO_2$ to allow attachment. Cells were washed once with PBS and incubated for 1 hour at 37° C. in sterile, 0.45 µm-filtered Krebs Ringer Buffer (KRB) containing 138 mM NaCl, 5.4 mM KCl, 2.6 mM $MgCl_2$, 2.6 mM $CaCl_2$, 5 mM NaHCO3, 10 mM HEPES and 5 g/L bovine serum albumin (Sigma). The cells were then washed in KRB once and stimulated for 1 hour in 100 µL of fresh KRB containing varying amounts of glucose and compounds. The insulin concentration was determined using an insulin ELISA (ALPCO) with the supplied protocol. Luciferase activity was determined from the same samples by adding the coelenterazine substrate (Nanolight) to the supernatant to a final concentration of 20 µM and reading on a standard plate reader (Biotek, Winooski, Vt.).

High-Throughput Screens

MIN6 and INS-1E cells were expanded to 80% confluence in their respective growth media, washed once in PBS and incubated for 1 hour at 37° C. in KRB without glucose. Cells were then dissociated, spun at 300 g×2 minutes, resuspended in fresh KRB without glucose and filtered through 40 µm mesh (Becton Dickenson). Next, the cells were counted and diluted in KRB to $1 \times 10^6$ cells per mL, and glucose was added as required for each experiment. Cells were then seeded in 384-well format, $3 \times 10^4$ cells in 30 µL per well, using a Multidrop Combi device (Thermo Scientific, Billerica, Mass.). Compounds from the Pharmakon 1600 Collection (Microsource Discovery Systems, Gaylordsville, Conn.) were pinned into each well using a CyBio Vario (CyBio, Jena, Germany) to a final concentration of 30 µM, and the plates were then incubated for 1 hour at 37° C. The plates were then spun at 300 g×2 minutes and the supernatant transferred to a new 384-well plate. Coelenterazine substrate was then added to a final concentration of 20 µM and luciferase activity determined using a standard plate reader (Biotek).

Data Analysis

For the high-throughput screens, the Z-score of each test compound was calculated using the formula:

$$Z-\text{score} = \frac{x - \mu}{\sigma}$$

where x is the log-transformed, signal decay-adjusted luciferase signal from a compound-treated well, µ is the mean of the log-transformed luciferase signals from the DMSO-treated wells on the same plate, and σ is the standard deviation of the log-transformed luciferase signals of the DMSO-treated wells across all plates (to allow for cross-plate comparison of compounds). Prior to calculating the Z-score, a row-based correction factor was applied to all luciferase readings to adjust for the rapid signal decay occurring during the course of each 384-well plate read. The signal decay was modeled as a logarithmic function (Microsoft Excel) and then used to adjust each well's luciferase reading based on the corresponding row within the plate.

Human Islet Cell Culture

Human islets were obtained through the Integrated Islet Distribution Program (http://iidp.coh.org/). Specific donor information is reported in Supplemental Table S2. Islets were maintained and dissociated in 96-well format as described[4]. To test compounds for their effects on insulin secretion, the dissociated islets were washed gently in KRB and incubated for 1 hour at 37° C. in KRB without glucose. The cells were then washed twice with KRB and placed in 100 μL of fresh KRB with 50 mg/dL glucose. Compounds were added to a final concentration of 50 μM and the cells were treated for 1 hour at 37° C. Thereafter, the supernatant was removed and the insulin concentration measured using an insulin ELISA (ALPCO) according to the manufacturer's instructions.

Example 2: Construction of Proamylin Fusion Proteins to Measure Amylin Secretion The key concept of our creation is that luciferase, when appropriately targeted to the secretory granule of a beta cell, can be used as a close proxy for insulin in a secretion assay. To target luciferase to the secretory granule of the beta cell, we created novel fusion proteins in which the sequence encoding *Gaussia* luciferase was placed within the open reading frame of proamylin, a peptide hormone that are normally co-secreted from the beta cell. *Gaussia* luciferase was chosen rather than a more commonly used luciferase because of its smaller size and more intense luminescence characteristics (1000 times brighter than Firefly luciferase). The construct showed robust luciferase response without any detrimental effect on beta cell viability or replication.

Amylin comprises about 1% of the protein in each secretory vesicle of the beta cell, and it is derived from a prohormone that undergoes cleavage by the same enzymes that convert proinsulin to mature insulin within these vesicles. Amylin differs from insulin in its smaller size, simplified protein structure and fewer cysteine residues involved in disulfide bridge formation. In our construct, we selected the mouse isoform of proamylin because it does not form toxic amyloid protein aggregates, unlike the human isoform. As shown in FIG. 1A, the luciferase was placed near the C-terminal end of the proamylin peptide, adjacent to an existing "prohormone convertase 2" (PC2) cleavage site. To increase the likelihood that the luciferase would function well after its release from the proamylin peptide, we added 6 bases encoding an additional PC2 cleavage site to the 3'-end of the luciferase sequence. As a result, the cleaved luciferase protein differed from the wildtype luciferase by only 3 additional amino acids located on its N-terminus, with no additional amino acids on its C-terminus.

Figure 1B:
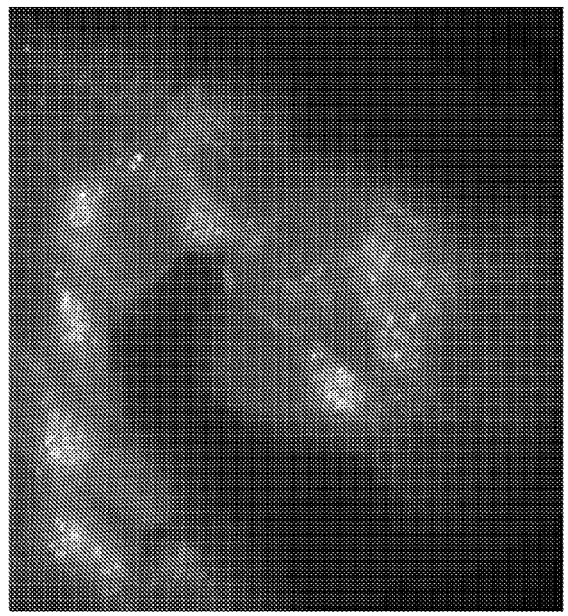
Figure 2B:
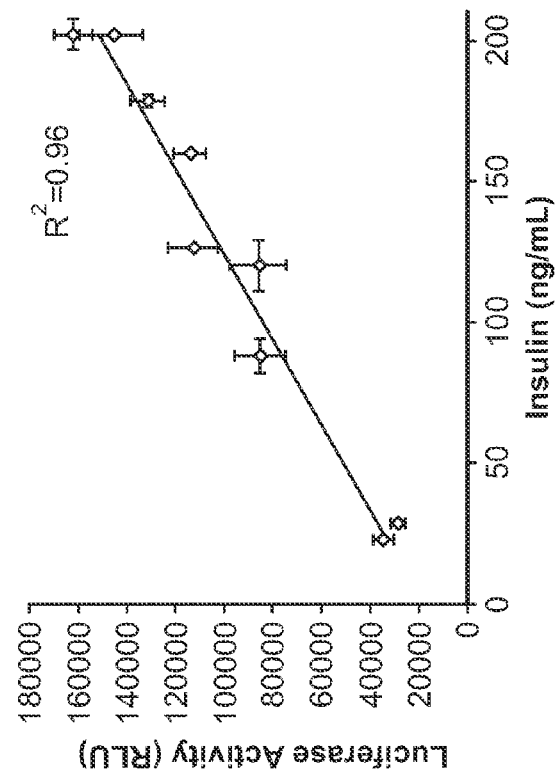
FIG. 2 is two graphs showing the validation of proamylin-luciferase reporter in MIN6 cells. Luciferase activity tracks closely with insulin concentration (as measured by ELISA) during glucose stimulation ($R^2$=0.96).
Figure 2A:
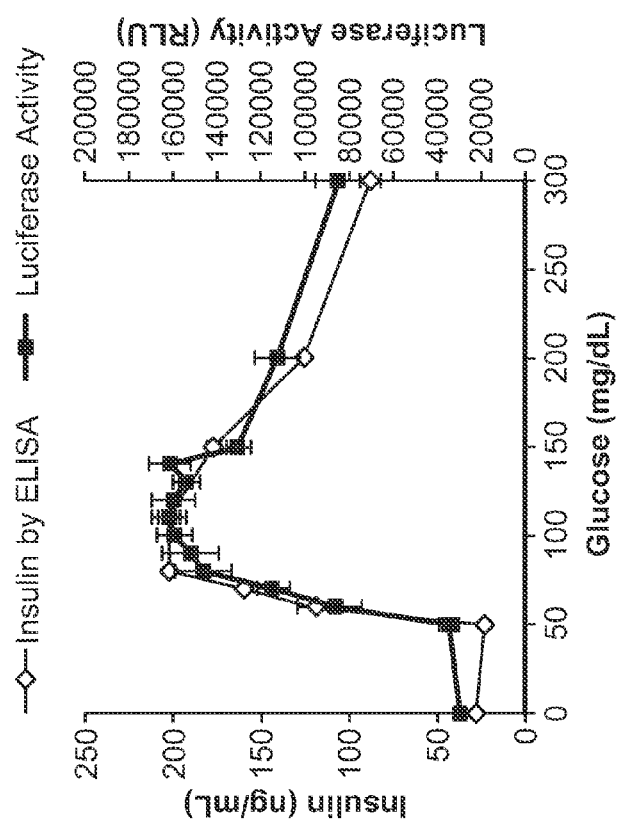
Figures 3A, 3B:
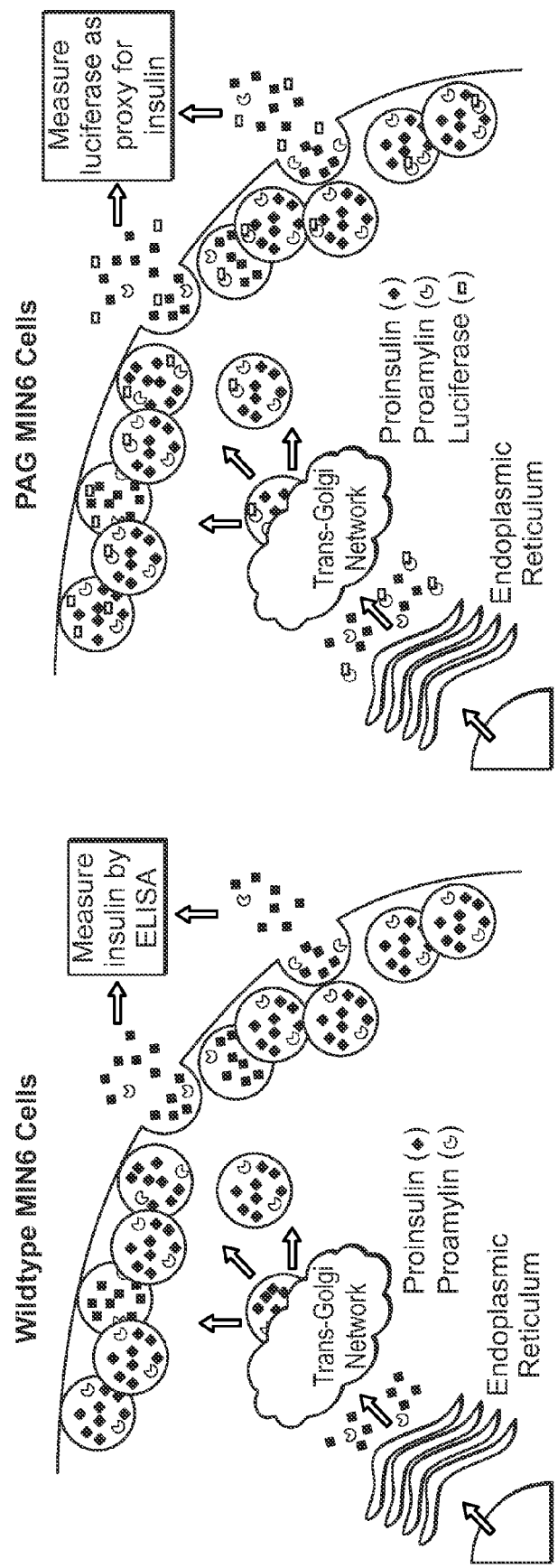
FIG. 3 is two schematics illustrating (A) wildtype MIN6 beta cells and (B) "PAG" containing MIN6 beta cells. Luciferase travels within proamylin from ER, through the Golgi and to the secretory vesicles, where it is cleaved out and co-secreted with endogenous insulin and amylin.
Figure 4:
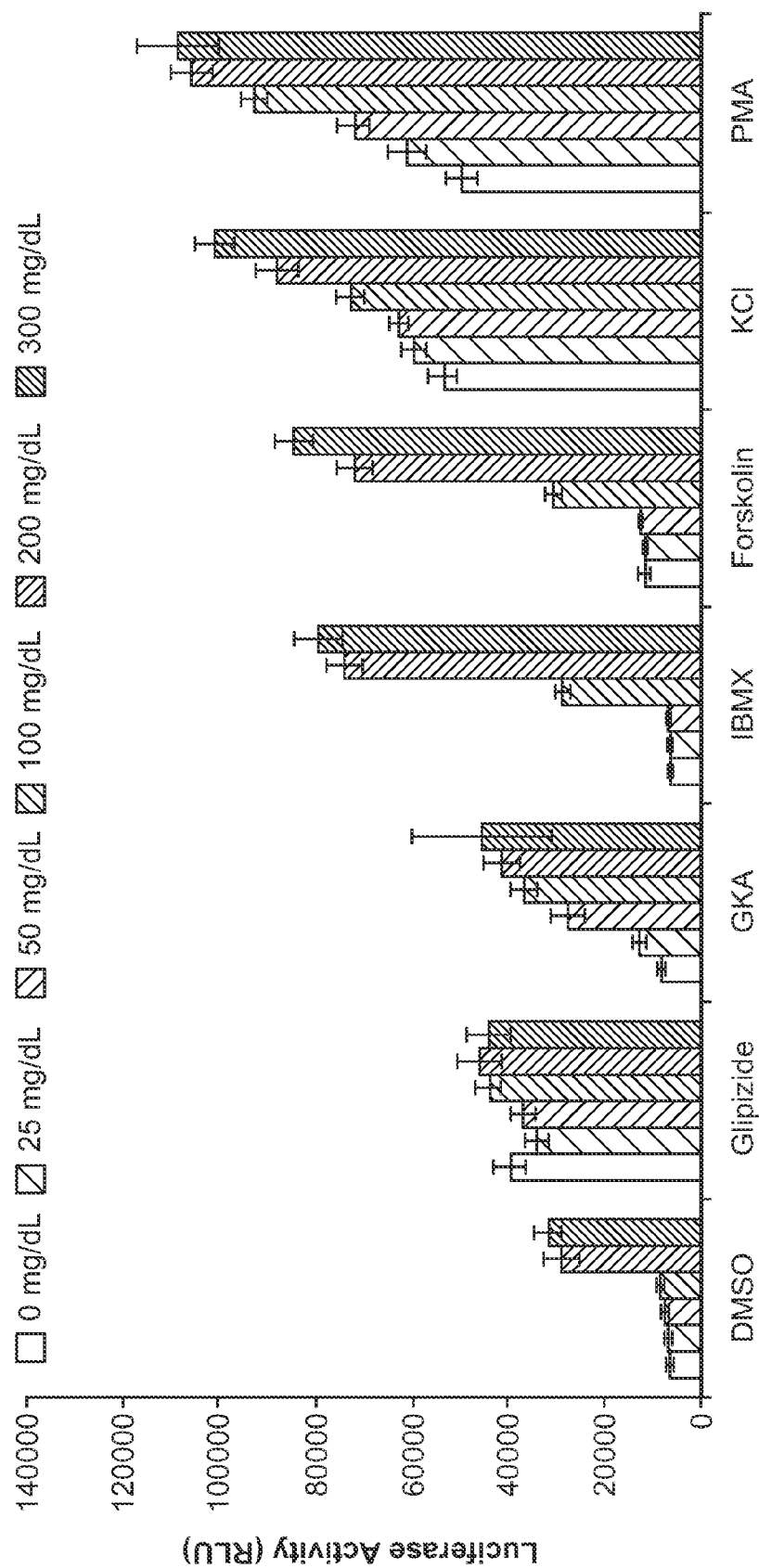
FIG. 4 is a graph showing the pre-proamylin-luciferase reporter in MIN6 cells responds as predicted to known insulin secretagogues. Cells were treated for 1 hour at the indicated glucose concentrations with either DMSO, 25 uM glipizide, 2.5 uM glucokinase activator (GKA), 50 uM 3-isobutyl-1-methylxanthine (IBMX), 20 uM forskolin, 40 mM potassium chloride (KCl), or 20 uM phorbol myristate acetate (PMA).

Example 3: Measurement of Insulin Secretion Using Preproamlyin Fusion Constructs The preproamlyin constructs was introduced into the MIN6 mouse beta cell line (FIGS. 3A and 3B). High magnification imaging studies by immunohistochemistry shows co-localization the luciferase protein with insulin in the secretory granules, as expected (FIG. 1B). Cells containing the reporter secreted luciferase in response to glucose and other secretagogues in close correlation with insulin, as measured by the standard ELISA (FIG. 2). In studies performed to date, the secreted luciferase appears to serve as a close proxy for secreted insulin (FIG. 4). Specifically, negative controls show treatment with DMSO and glipizide even at high concentrations did not increase luciferase activity. Stimulation of cells with IBMX, forskolin, KCl, and PMA increased luminescence in a dose-dependent manner, indicating that the secreted luciferase can be used as an accurate readout of amylin or insulin secretion.

Figure 5:
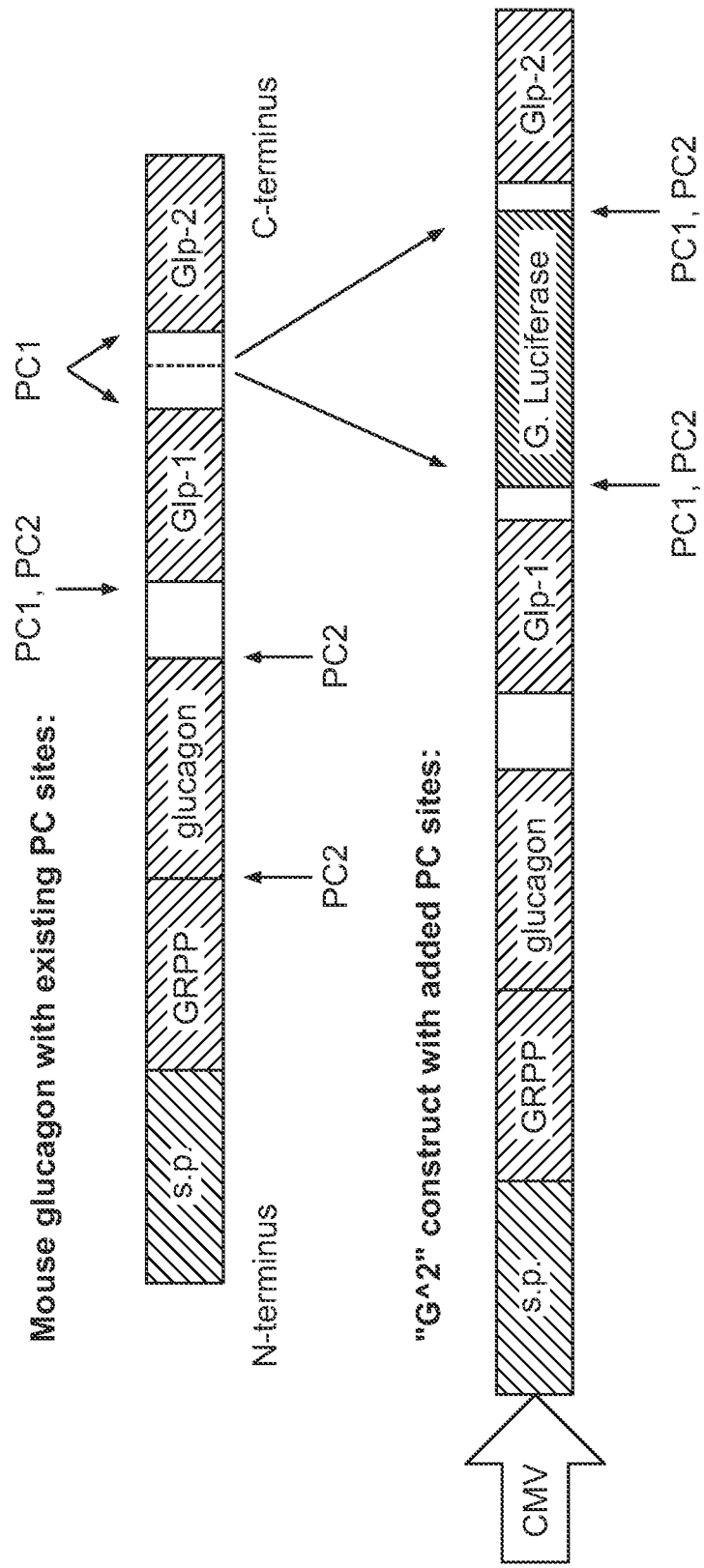
FIG. 5 depicts the structure of proglucagon-*Gaussia* luciferase (G2) construct. The luciferase was placed between the Glp-1 and the Glp-2 peptides; flanked by PC1 and PC2 cleavage sites on the N and C-terminal ends. s.p. stands for signal peptide.

Example 4: Construction of Proglucagon Fusion Protein to Measure Glucagon and Glp-1 Secretion The glucagon gene contains sequences encoding 4 peptide hormones: (a) Grpp, (b) glucagon, (c) Glp-1, and (d) Glp-2 (FIG. 5). Preglucagon processing results result in glucagon or Glp-1 secretion. The construct described herein allows for detection of glucagon or Glp-1 secretion. A preproglucagon-luciferase (G2) reporter was constructed using mouse glucagon, which contains endogenous PC1 and PC2 sites that are utilized to produce glucagon or Glp-1. The $G^2$ construct was constructed similarly to the proinsulin and proamylin constructs described supra. The *Gaussia* luciferase gene was inserted near the C-terminal end of the proglucagon peptide, between the Glp-1 and Glp-2-encoding peptides Importantly, both PC1 and PC2 cleavage sites were added to the N-terminal and C-terminal ends of the *Gaussia* luciferase. The cellular context determines which cleavage sites are utilized for glucagon processing. For example, introduction of the $G^2$ construct into PC1-expressing L cells would result in cleavage at the PC1 sites for Glp-1 secretion, while introduction of the $G^2$ construct into PC2-expressing alpha cells would result in cleavage at the PC2 sites for glucagon secretion.

Example 5: Measuring Glucagon and Glp-1 Secretion

Figure 6:
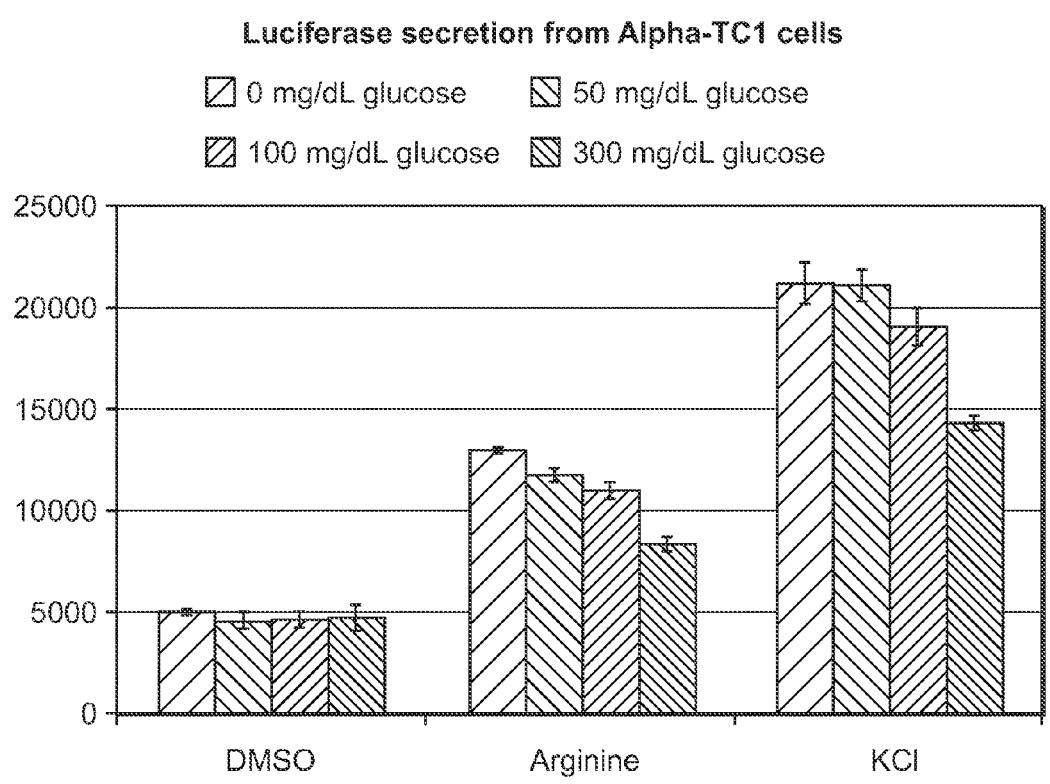
FIG. 6 is a graph establishing that the secreted luciferase serves as a close proxy for secreted glucagon. The G2 construct was transfected into mouse alpha cells. Luciferase secretion was measured by luciferase activity in response to stimulation with arginine or KCl and varying dosages of glucose (DMSO was used as control).

The preglucagon $G^2$ construct was introduced into the Alpha TC1 mouse alpha cell line. Cells were stimulated with IBMX, arginine, or potassium chloride (KCl) and varying amounts of glucose in the range of 0-300 mg/dL (0-16.7 mM). Luciferase activity of the supernatant was determined (FIG. 6). As expected, the $G^2$-expressing alpha cells secreted luciferase in response to arginine and KCl1 in a glucose-dependent manner. There was no secretion of luciferase in response to IBMX, also as expected. This assay demonstrates that the secreted luciferase appears to serve as a close proxy for secreted glucagon.

Figure 7B:
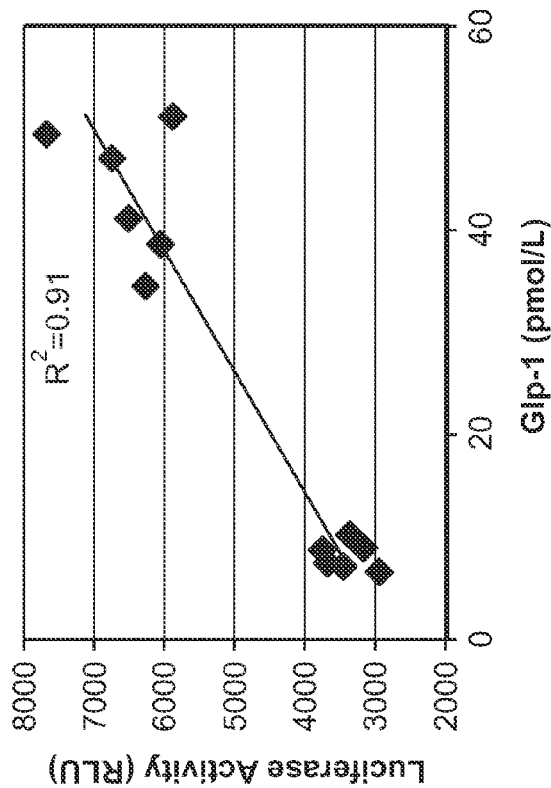
FIG. 7 is two graphs establishing that the secreted luciferase serves as a close proxy for secreted Glp-1. The G2 construct was transfected into mouse L cells. A) Luciferase secretion was measured by luciferase activity in response to stimulation with forskolin/IBMX, KCl, glipizide, PMA or L-glutamine. B) The correlation of luciferase secretion (signal) with secreted Glp-1 concentration was very high.
Figure 7A:
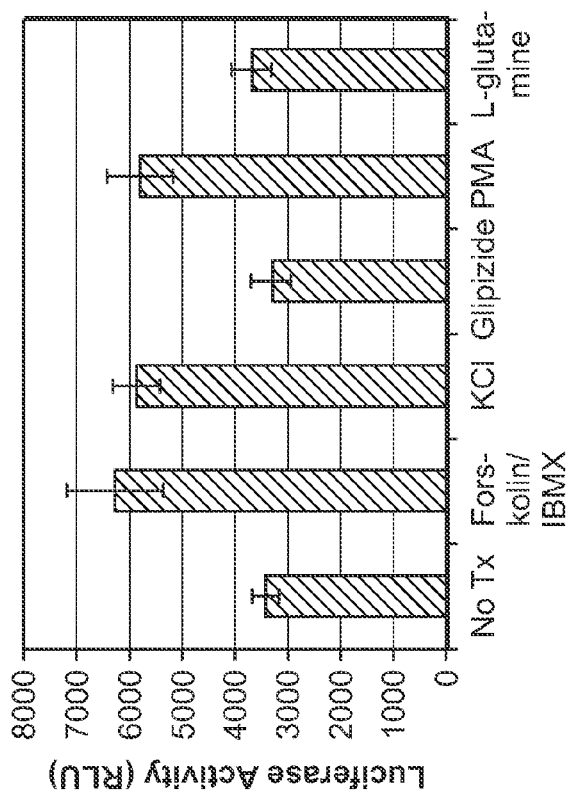

The proglucagon $G^2$ construct was also introduced into the GLUTag mouse L-cell line. Cells were stimulated with Forskolin/IBMX, KCl, glipizide, PMA, and L-glutamine. Luciferase activity of the supernatant was determined. As expected, the $G^2$-expressing L-cells secreted luciferase in response to forskolin/IBMX, Kcl and PMA; and also as expected, there was no secretion of luciferase in response to glipizide or L-glutamine (FIG. 7A). Glp-1 secretion was measured by standard ELISA and results show that luciferase secretion is closely correlated with Glp-1 secretion (FIG. 7B). Taken together, these assay results demonstrate that the secreted luciferase serves as a close proxy for secreted Glp-1. The $G^2$ reporter was also tested in L-cells in 384-well format, to demonstrate the amenability of the reporter in a high throughput format.

Example 6: Construction of Proinsulin Fusion Proteins to Measure Insulin Secretion To enable high-throughput investigation of genes and compounds affecting insulin secretion, a simple, reproducible, and much less expensive assay was needed. We reasoned that luciferase could be used to create such an assay, if the enzyme could be properly targeted to secretory vesicles in the beta cell via the natural proinsulin processing pathway. To test this hypothesis, we constructed a proinsulin-luciferase fusion protein in which we placed the sequence of *Gaussia* luciferase within the C-peptide portion of proinsulin (FIG. 8A), a fragment that is normally cleaved by prohormone convertases and co-secreted with mature insulin during exocytosis (Oyer, P. E. et al. J Biol Chem 246:1375-1386 (1971)).

Figure 8A:
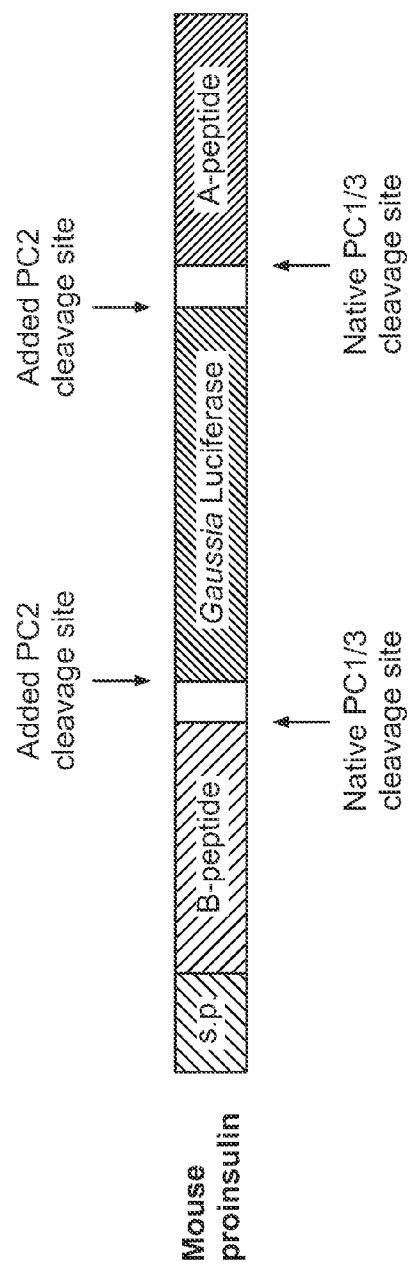
FIG. 8 shows characterization of the proinsulin-luciferase fusion protein. (A) Diagram of proinsulin-luciferase fusion construct, showing *Gaussia* luciferase within the C-peptide portion of proinsulin. The natural secretory signal peptide of *Gaussia* luciferase was removed to prevent unregulated secretion; the luciferase sequence was flanked with recognition sites for prohormone convertase 2 (PC2) to minimize carryover of extraneous amino acids after processing within the secretory vesicles. (B) Immunohistochemistry of INS-1E cells expressing the proinsulin-luciferase reporter, stained for luciferase (green, left), insulin (red, middle), or both (merged, right). (C) Glucose-stimulated secretion of luciferase (red) and insulin (blue) from MIN6 cells expressing the fusion construct (left). Correlation between insulin concentration and luciferase activity (right). (D) Assessment of luciferase secretion induced by known insulin secretagogues. Cells were treated for 1 hour at the indicated glucose concentrations with either DMSO, 25 uM glipizide, 2.5 uM glucokinase activator (GKA), 20 mM arginine, 1 nM glucagon-like peptide-1 (GLP-1), 50 uM 3-isobutyl-1-methylxanthine (IBMX), 20 uM forskolin, 40 mM potassium chloride (KCl), or 20 uM phorbol myristate acetate (PMA). Correlation between insulin and luciferase secretion for all samples (right).

As shown in FIG. 8A we placed the luciferase within the c-peptide portion of proinsulin, and near the C-terminal end of the proamylin peptide adjacent to an existing "prohormone convertase 2" (PC2) cleavage site. To increase the likelihood that the luciferase would function well after its release from each prohormone, we added PC2 cleavage sites to both ends of the luciferase using in the proinsulin construct, and to the 3'-end of the luciferase used in the proamylin construct. After cleavage, the luciferase protein will therefore differ only minimally from the wildtype luciferase protein.

We envisioned that luciferase would remain trapped within proinsulin until cleavage of the fusion protein by pH-sensitive prohormone convertases resident in secretory vesicles, enabling its co-secretion with mature insulin after stimulation of the beta cell.

Figure 8B:
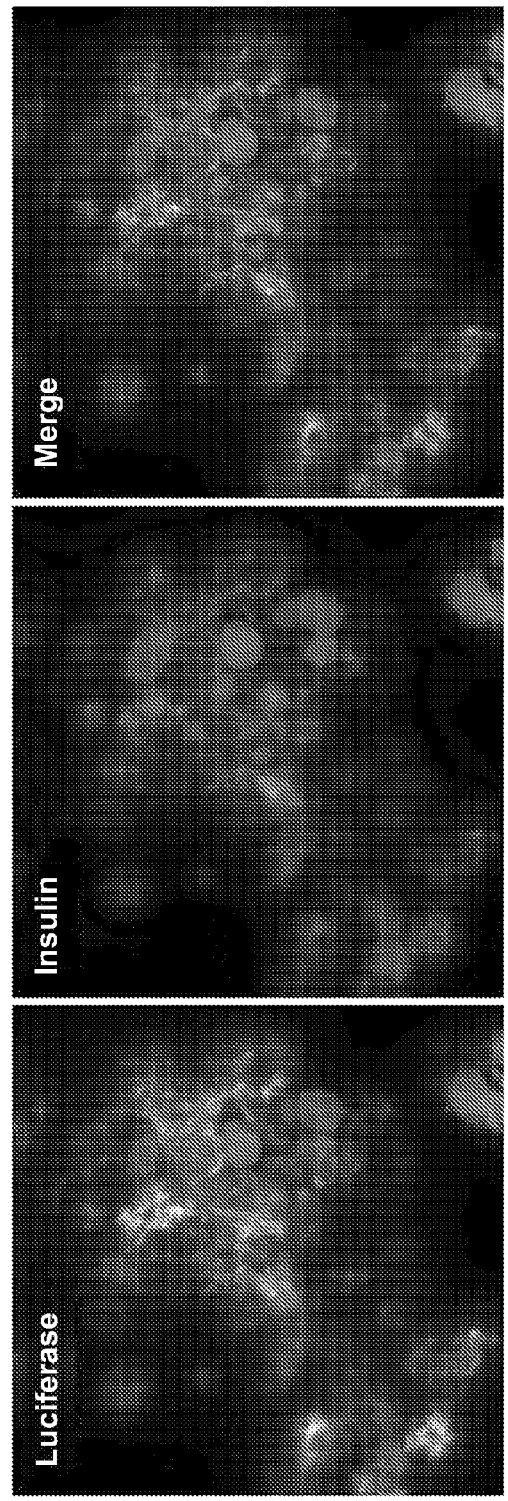
Figure 8D:
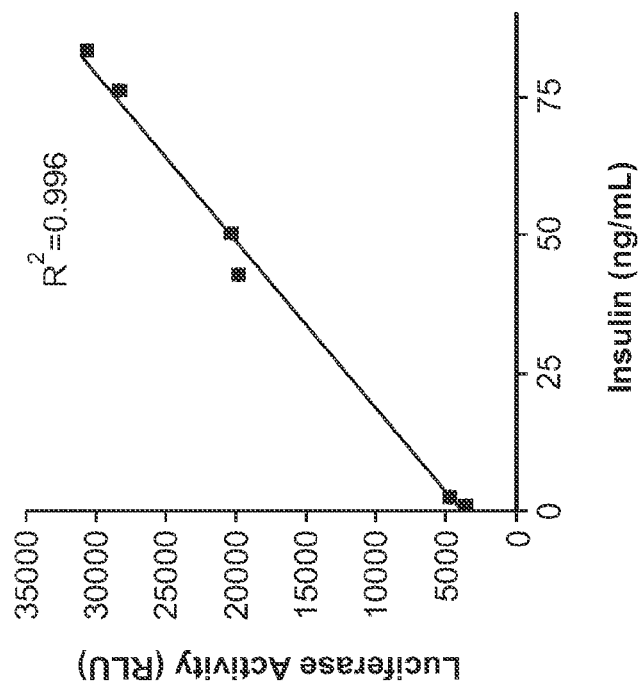
Figure 8C:
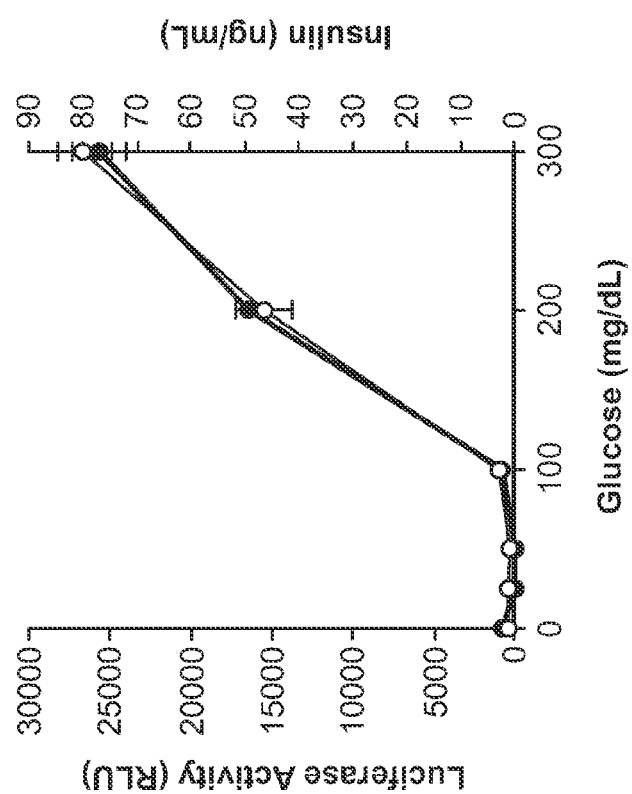
Figures 8E, 8F:
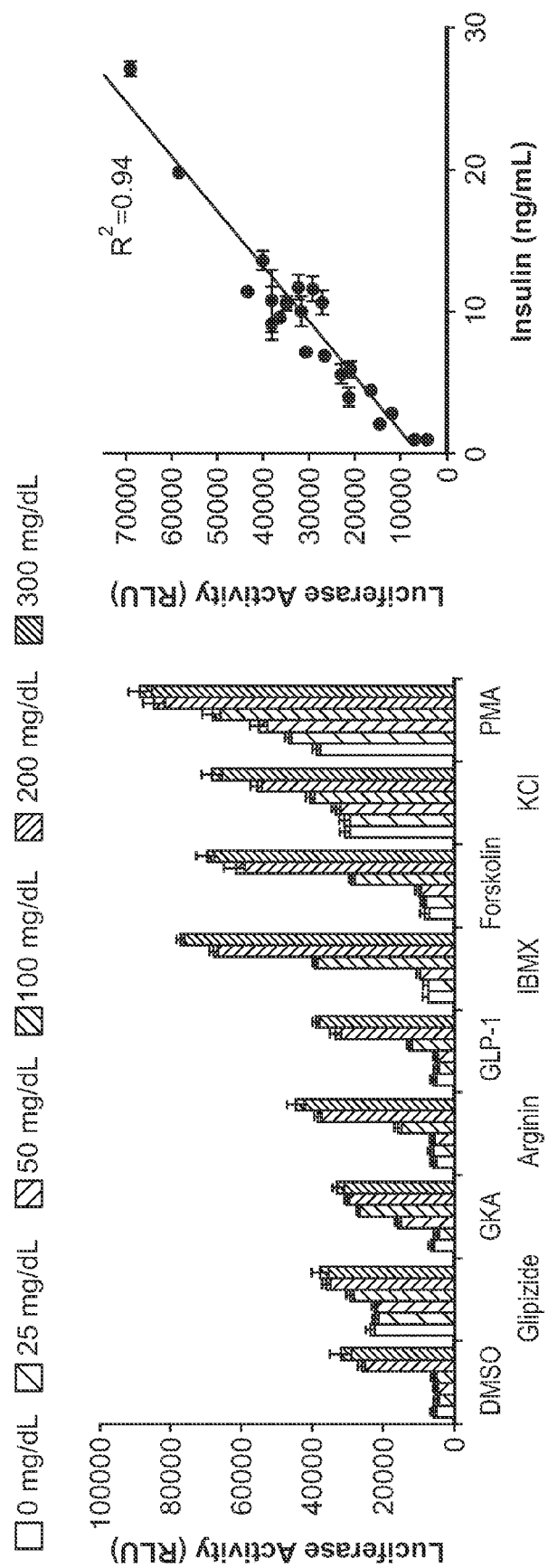

Upon expression of the construct under the control of a constitutive promoter in rodent beta-cell lines (Miyazaki, J. et al. Endocrinology 127:126-132 (1990); Merglen, A. et al. Endocrinology 145:667-678 (2004)), we observed strong co-localization of insulin and luciferase within the secretory granules of most cells (FIG. 8B). Challenging the cells with increasing glucose concentrations induced secretion of both luciferase and insulin, as measured by ELISA, in close correlation ($r^2$=0.996) (FIG. 8C). Furthermore, upon treatment of the cells with established insulin secretagogues, luciferase secretion tracked closely with insulin in each instance (FIG. 8D).

Example 7: High Throughput Screening Using the Proinsulin Fusion Protein

Figure 9A:
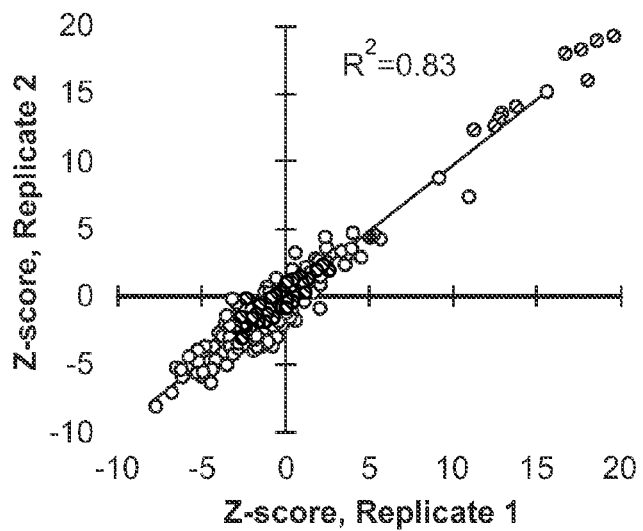
FIG. 9 shows the application of proinsulin-luciferase reporter to high-throughput chemical screen. (A) Scatter plot of the results of high-throughput screening of 1600 compounds for luciferase secretion using MIN6 cells expressing proinsulin-luciferase construct. The screen was performed in duplicate in the presence of sub-stimulatory 100 mg/dL glucose, and Z-scores were calculated based on the DMSO control distribution. DMSO controls shown in red, glipizide in green, KCl in yellow, test compounds in blue. (B) Insulin secretion induced by the top-scoring compounds in MIN6 cells in the presence of sub-stimulatory 100 mg/dL glucose, as measured using a standard insulin ELISA. (C) Effect of same eight compounds on insulin secretion from dissociated human islets, in the presence of sub-stimulatory 50 mg/dL glucose. (D) Scatter plot comparing results of high-throughput screening for luciferase secretion in presence and absence of glucose. DMSO controls shown in red, glipizide in green, glucokinase activator in yellow, test compounds in blue. (E) Measurement of insulin secretion induced by hit compounds in MIN6 cells, in presence (100 mg/dL, in red) and absence (0 mg/dL, in blue) of glucose. Data represent the average±standard deviation of 2 replicates.

We next sought to determine the potential of the proinsulin-luciferase reporter cell line for high-throughput screening by optimizing the assay for 384-well format, where it exhibited tight reproducibility (CV<5%) and excellent separation between positive and negative controls (Z' factor 0.6) (Zhang, J. H. et al. J Biomol Screen 4:67-73 (1999)). We performed a pilot chemical screen at a substimulatory glucose concentration (100 mg/dL) in MIN6 cells using a collection of 1600 known bioactive small molecules, with the sulfonylurea glipizide included as a positive control. Each compound was tested in duplicate, and we observed high reproducibility within experimental replicates ($R^2$=0.80) (FIG. 9A). Several commonly used drugs without known links to beta-cell function caused significant increases in luciferase secretion in our assay (compounds summarized in Table 1).

TABLE 1

Top insulin secretagogues from 1600 compound screen, active in both the presence and absence of glucose.

| Compound | Z-score | Annotation |
| --- | --- | --- |
| Triamterene | 76.3 | Potassium-sparing diuretic |
| Tyrothricin | 52.4 | Topical antibiotic |
| Trihexyphenidyl | 50.5 | Anticholinergic |
| Levosimendan | 40.7 | Calcium sensitizer used in CHF |
| Tacrine | 38.8 | Cholinesterase inhibitor |
| Monobenzone | 38.7 | Decreases melanin excretion |
| (S)-chlorpheniramine | 31.8 | Antihistamine |
| Orphenadrine | 27.4 | Anticholinergic |
| Nafronyl | 25.4 | Serotonin-R antagonist |
| Camylofine | 23.8 | Anticholinergic |

Figure 9B:
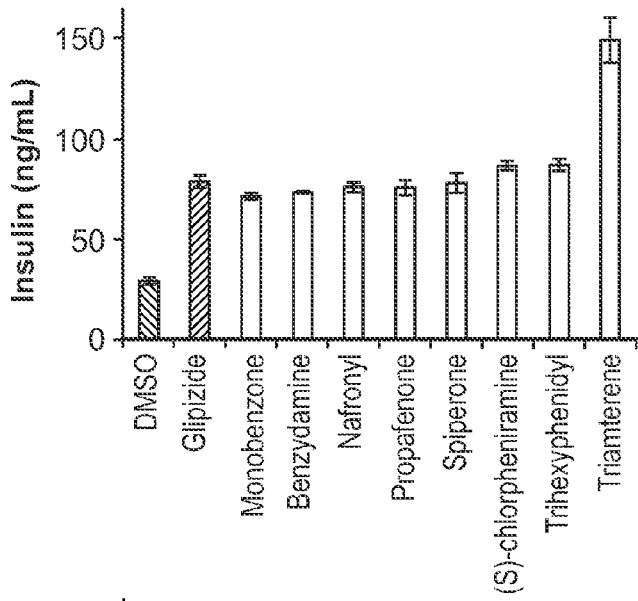

To confirm that the results from the luminescent assay were reflective of insulin secretion, we treated MIN6 cells with the top hits from the primary screen and measured insulin secretion using the standard ELISA. All top-scoring compounds increased insulin secretion, some to a level higher than that of our positive control, glipizide (FIG. 9B). Next, to determine if our assay could identify compounds with relevance to human beta-cell function, we tested the top compounds for effects on insulin secretion at 50 mg/dL glucose using dissociated human pancreatic islet cells (Table 2) (Walpita, D. et al. J Biomol Screen 17:509-518 (2012)).

TABLE 2

Summary of human islet information.

| | |
| --- | --- |
| Age: | 54 years-old |
| Gender: | male |
| Height: | 77 inches |
| Weight: | 278 pounds |
| BMI: | 33 |
| Islet purity: | 85% |
| Islet viability: | 93% |
| Cause of death: | cerebrovascular accident (stroke) |

Figure 9C:
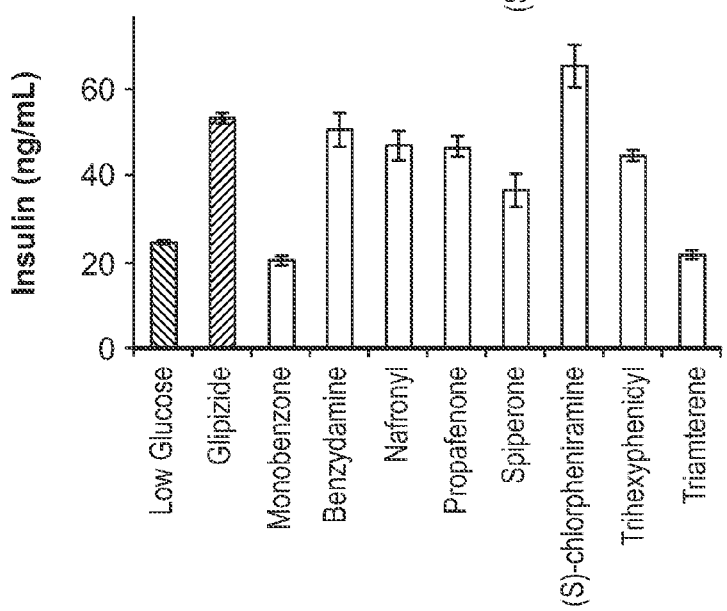

Six of the eight compounds augmented insulin secretion from human beta cells to a similar extent as glipizide (FIG. 9C).

Figure 9D:
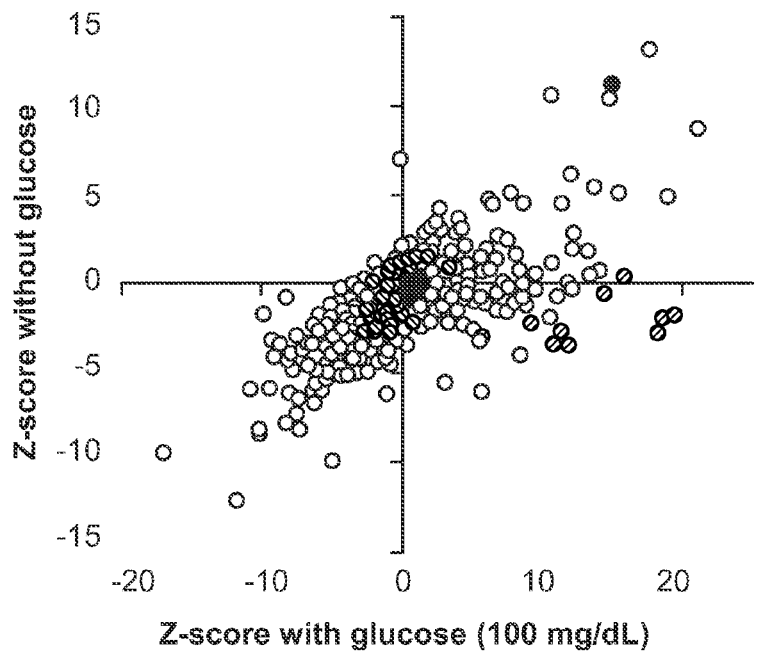
Figure 9E:
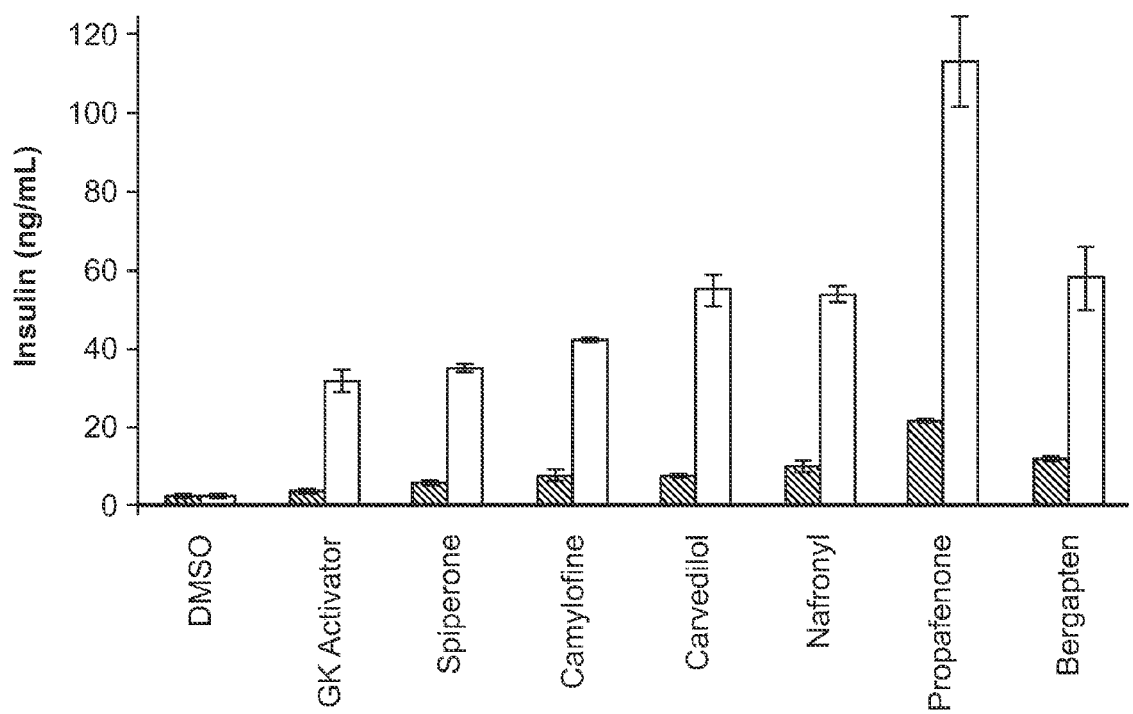

As there is a well-recognized need for glucose-dependent small-molecule agonists of insulin secretion, we subsequently evaluated whether our assay could be adapted to find such secretagogues. We repeated the 1600-compound screen in the presence and absence of a substimulatory glucose concentration (100 mg/dL). As expected, the sulfonylurea glipizide caused luciferase secretion regardless of the ambient glucose level, while several compounds appeared to have the desired property of increasing luciferase secretion only in the presence of glucose (FIG. 9D). We confirmed that these compounds augment insulin secretion only in the presence of glucose using the standard ELISA in MIN6 cells (FIG. 9E). Notably, none of the top-scoring compounds in this screen have been previously reported to affect insulin secretion (Table 3).

TABLE 3

Top glucose-dependent insulin secretagogues from 1600 compound screen, active only in the presence of a permissive glucose environment.

| | Z-score | | | |
| --- | --- | --- | --- | --- |
| | With Glucose | Without Glucose | Δ | Annotation |
| Monobenzone | 31.8 | 5.6 | 26.2 | Decreases melanin secretion |
| Bergapten | 20.9 | 2.9 | 18 | Citrus product, alters K currents |
| Hydroxyprogesterone | 18.3 | 2.7 | 15.6 | Steroid hormone |
| Nafronyl | 17.8 | 3.4 | 14.4 | Serotonin-R antagonist |
| Clemizole | 12.2 | 0.4 | 11.8 | Antihistamine |
| Spiperone | 9.0 | -2.8 | 11.8 | Serotonin-R, DA-R antagonist |
| Propafenone | 10.5 | 1.5 | 9 | Na-channel, beta blocker |
| Carvedilol | 10.2 | 1.5 | 8.7 | Alpha-1, beta blocker |
| Camylofine | 4.7 | 0.2 | 4.5 | Antimuscarinic |

As compared to the standard ELISA, our luminescent insulin secretion reporter assay has the advantages of simplicity, at least a 50-fold decrease in cost, and reproducibility in high-throughput screening applications. After stimulation of beta cells expressing the fusion protein, luciferase activity in the supernatant is determined by simply adding the luciferase substrate coelenterazine and measuring the resulting luminescence with a plate reader. No wash steps are required and the procedure takes less than one minute to complete per 384-well plate.

Much like an ELISA, our assay detects changes in the secretion of insulin rather than in its expression. Other groups have described reporters in which a luciferase is placed under the control of the insulin promoter (Olansky, L. et al. J Clin Invest 89:1596-1602 (1992)), and while these are useful for tracking gene transcription, they are not applicable to screens of insulin release as the transcriptional activity of insulin correlates poorly with its secretion.

In summary, we have created a fast and inexpensive luminescent assay to accurately and reproducibly detect insulin secretion in high-throughput screening applications. In addition to chemical screening, this reporter should prove useful for investigating (1) genes impacting beta-cell function, (2) physiologic stressors relevant to diabetes, and (3) culture conditions promoting differentiation of stem cells into insulin-secreting beta cells. More generally, our prohormone-luciferase fusion design may prove useful to monitor the secretion of other disease-relevant peptide hormones for which ELISA-based methods are even more limited, including glucagon, GLP-1, and peptide YY. Such luminescent hormone secretion reporters would represent valuable tools in the search for drugs to treat metabolic and endocrine disorders.

As described supra, high throughput screening of compounds that modulate other hormone secretion can also be performed. For example, screening of compounds that modulate, increase, or decrease secretion of amylin, glucagon, or Glp-1 can be performed using the fusion protein constructs described herein and the methods described supra.

Furthermore, the methods demonstrated supra can also be used for high throughput screening of compounds that modulate peptide secretion. For example, screening of compounds that modulate, increase, or decrease secretion of peptides such as neuropeptides and cytokines can be performed using the fusion protein constructs described herein. The methods demonstrated supra can also be used for high throughput screening of compounds that modulate cell surface expression of transmembrane proteins or peptides. For example, screening of compounds that modulate, increase, or decrease the cell surface expression of transmembrane proteins can be performed using the fusion protein constructs described herein.

Example 8: Screening for Genes that Modulate Peptide Secretion or Cell Surface Expression The hormone-luciferase constructs of the invention can be used in high throughput screens to find genes that significantly alter the secretion of hormones of interest, for example insulin (in response to glucose), amylin, glucagon or Glp-1.

We are currently using our proinsulin construct in the MIN6 and INS-1E beta cell lines to perform a pilot RNAi screen of genes known to impact insulin secretion. The effect of silencing the expression of these positive control genes will be assessed using the luciferase readout. Ample negative control hairpins will also be included in this pilot study to characterize the baseline variability of luciferase secretion. Once the assay is validated for use with RNAi constructs, a targeted RNAi screen can be performed against genes recently implicated by human genetics in the pathogenesis of type 2 diabetes and intermediate traits, such as fasting glucose.

Genome wide association studies have identified over 40 sequence variants linked to this disease, many of which affect insulin levels after a glucose challenge, yet in most cases the risk polymorphism is non-coding and thought to impart risk for disease through changes in the expression of a nearby gene. We will cast a wide net by testing RNAi constructs against all genes within +/−300 kilobases from each risk variant, or about 120 genes in total. The RNAi Consortium at the Broad has created 5-10 hairpins targeting each of these genes, and we will test each available construct for an effect on insulin secretion using our luciferase-based assay. "Hits" from this primary screen will be confirmed through repeat testing with our assay, and then validated in an independent assay using a commercially available insulin ELISA.

Pending the results from this targeted RNAi screen, we anticipate performing an unbiased genome wide RNAi screen to comprehensively explore the genes regulating insulin secretion in the beta cell. Should a human beta cell line become available, we will validate our construct in this line and then use it to perform the RNAi screen using the Broad's human lentiviral shRNA library.

Other propeptide-luciferase constructs of the present invention can also be utilized in assays to determine genes that modulate peptide secretion or cell surface expression of the peptide.

Example 9: Screening for Compounds that Modulate Peptide Secretion or Cell Surface Expression Our invention allows for the high throughput measurement of hormone secretion in the setting of genetic and chemical perturbations, and as such is well suited to screens for compounds impacting this physiologic process. The hormone-luciferase constructs of the invention can be used in small molecule cell-based screens to find compounds that significantly alter the secretion of hormones of interest, for example insulin (in response to glucose), amylin, glucagon or Glp-1.

As described in Example 7, we have performed a pilot screen using the proinsulin fusion protein to screen 1600 known bioactive small molecules, which identified several compounds that increase insulin secretion in a glucose-dependent manner. Based on these results, we were selected to participate in the NIH MLPCN program, which will allow us to screen >350,000 compounds for similar effects on insulin secretion.

Similarly, any of the fusion proteins of the present invention can be used in screens for compounds that modulate hormone secretion. Pilot screens will be performed involving 6 plates of compounds enriched for known bioactive molecules. Based on the results from this initial screen, we anticipate testing a larger collection of compounds to fully explore the interaction of small molecules with the pathways regulating insulin secretion. Targets of any compounds identified in these screens will be sought using the tools of the Chemical Biology and Proteomics groups at the Broad, so as to determine the relevant molecular pathways.

As described in Example 8, genes that regulate hormone secretion can be identified using the described invention. Once genetic variants are identified that adversely affect insulin secretion, we will screen small molecules for their ability to reverse or modulate this genetic effect, so as to increase our understanding of the underlying biology.

Furthermore, genes that regulate secretion of other peptides, such as neuropeptides and cytokines can also be identified using the described invention. Similarly, genes that regulated the cell surface expression of transmembrane proteins can also be identified using the described invention. Similarly, once genetic variants are identified that adversely affect peptide secretion or cell surface expression, small molecules can then be screened for their ability to reverse or modulate the genetic effect.

Example 10: Screening for Factors that Differentiate Cells

Figure 10:
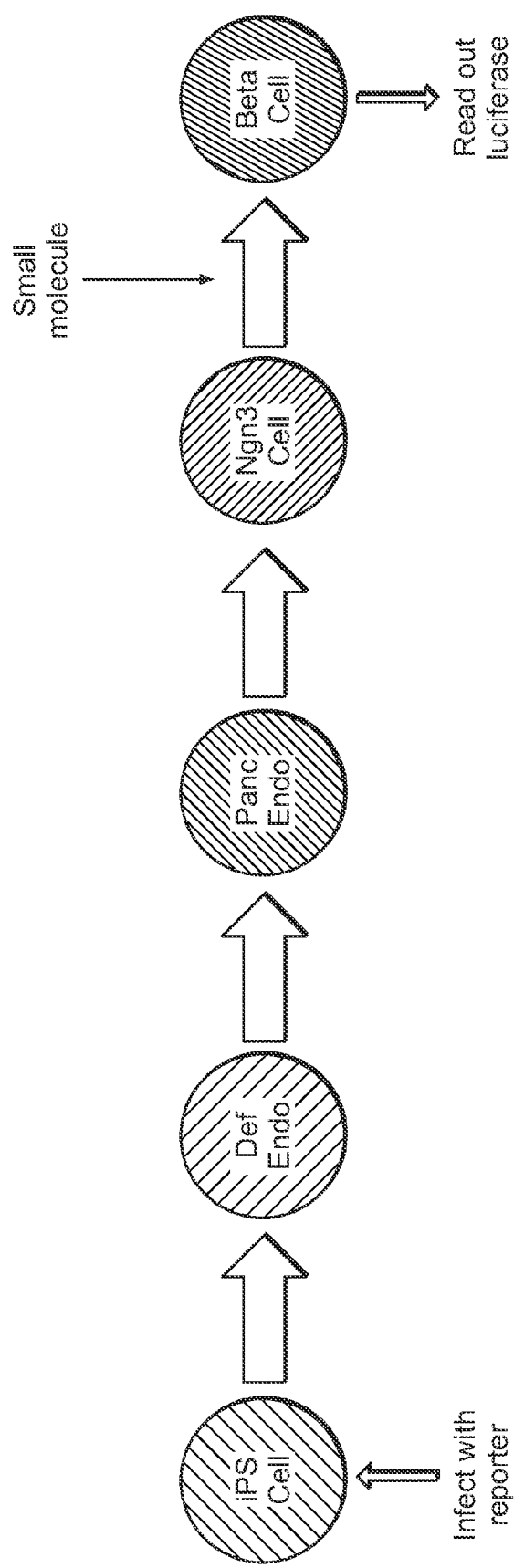
FIG. 10 is a schematic depicting an assay to screen for beta cell differentiation from iPS cells using luciferase secretion as the readout as a marker for beta cell maturation.
Figure 11:
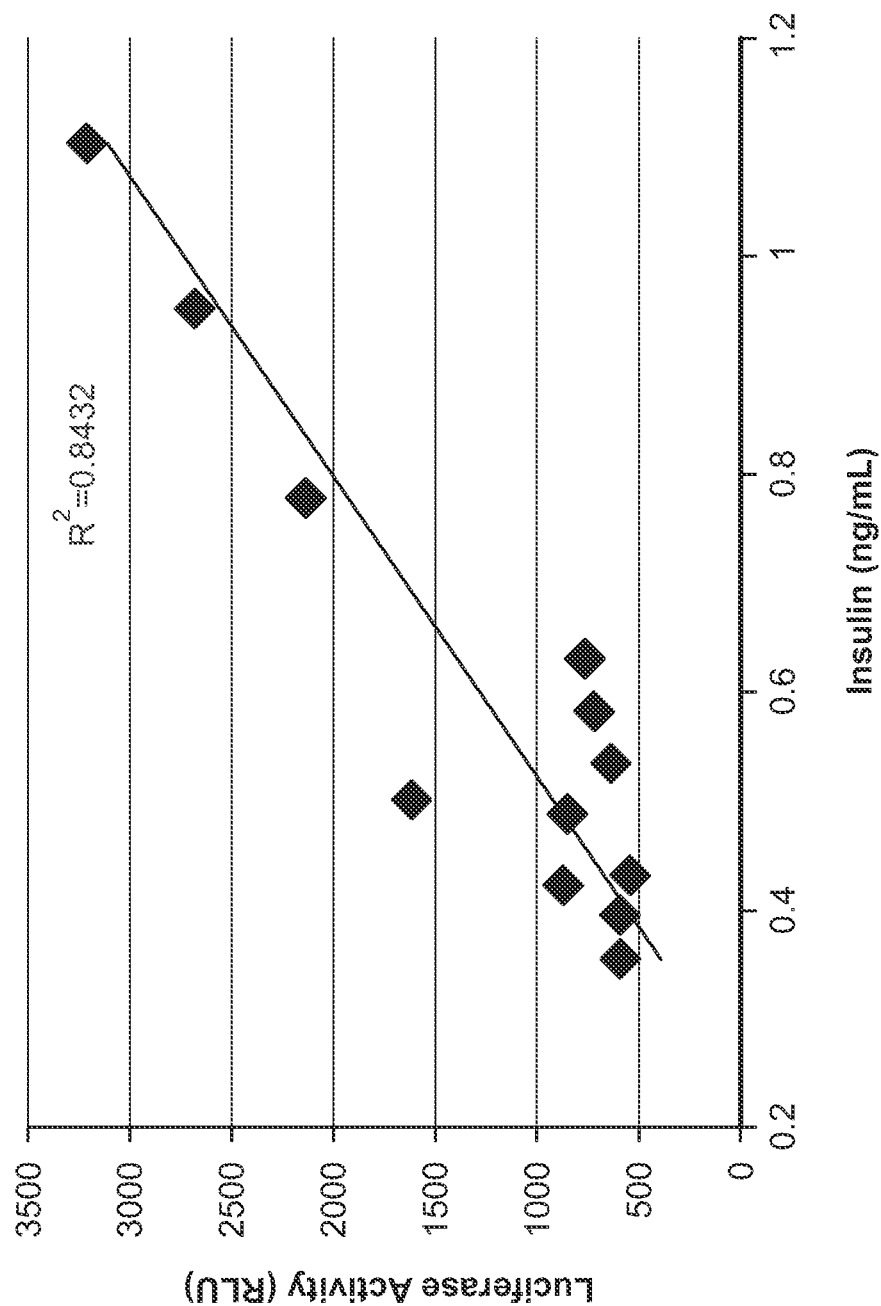
FIG. 11 is a graph depicting the correlation between secreted luciferase and secreted insulin from proinsulin reporter-expressing human beta-like cells.

In addition to using the hormone reporter constructs for screening compounds or genes that modulate and peptide secretion, the present invention provides a method for screening for factors that can differentiate iPS cells or ES cells into pancreatic beta cells competent for hormone secretion (FIG. 10). The present invention also provides a method for screening for factors that can differentiate iPS or ES cells into any differentiated or mature cell that is capable of peptide-secretion or cell surface expression of the particular peptide of interest. ES or iPS cells are infected with any of the reporter constructs of the present invention, and can be differentiated using methods known in the art. Luciferase secretion is used as a marker of cell maturation in screens to identify compounds (such as small molecules) or other factors that induce cell differentiation and maturation. As an initial experiment, human beta-like cells were infected with the proinsulin reporter construct. Luciferase activity was detected as described supra, and insulin secretion was measured by standard ELISA (FIG. 11). Results indicate that the luciferase signal and secreted insulin were closely correlated, therefore demonstrating that the reporter construct can be used as a marker for beta cell maturation.

One of ordinary skill in the art can use this example as guidance to screen factors that differentiate iPS or ES cells into a differentiated or mature cell.

SEQUENCE LISTING (395 sequences)

SEQ ID NO: 1 - DNA, 504 bp, Gaussia princeps
aagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgac

SEQ ID NO: 2 - DNA, 558 bp, Gaussia princeps
atgggagtcaaagttctgtttgccctgatctgcatcgctgtggccgaggccaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 3 - DNA, 1626 bp, Cypridina noctiluca
tactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaa

SEQ ID NO: 4 - DNA, 1662 bp, Cypridina noctiluca
atgaagaccttaattcttgccgttgcattagtctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaatag

SEQ ID NO: 5 - DNA, 282 bp, Mus musculus
atgatgtgcatctccaaactgccagctgtcctcctcatcctctctgtggcactgaaccacttgagagctacacctgtcagaagtggtagcaaccctcagatggacaaacggaagtgcaacacggccacgtgtgccacacaacgcctggcaaactttttggttcgttccagcaacaaccttggtccagtcctcccaccaaccaacgtgggatcgaatacatatggcaagaggaatgcggcaggggatccaaatagggaatccttggatttcttactcgtttaa

SEQ ID NO: 6 - DNA, 270 bp, Homo sapiens
atgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttag

SEQ ID NO: 7 - DNA, 333 bp, Mus musculus
atggccctgtggatgcgcttcctgcccctgctggccctgctcttcctctgggagtcccaccccacccaggcttttgtcaagcagcacctttgtggttcccacctggtggaggctctctacctggtgtgtggggagcgtggcttcttctacacacccatgtcccgccgtgaagtggaggacccacaagtggcacaactggagctgggtggaggcccgggagcaggtgaccttcagaccttggcactggaggtggcccagcagaagcgtggcattgtagatcagtgctgcaccagcatctgctccctctaccagctggagaactactgcaactag

SEQ ID NO: 8 - DNA, 333 bp, Homo sapiens
atggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactag

SEQ ID NO: 9 - DNA, 543 bp, Mus musculus
atgaagaccatttactttgtggctggattgcttataatgctggtgcaaggcagctggcagcacgcccttcaagacacagaggagaaccccagatcattcccagcttcccagacagaagcgcatgaggaccctgatgagatgaatgaagacaaacgccactcacagggcacattcaccagcgactacagcaaatacctggactcccgccgtgcccaagattttgtgcagtggttgatgaacaccaagaggaaccggaacaacattgccaaacgtcatgatgaatttgagaggcatgctgaagggacctttaccagtgatgtgagttcttacttggagggccaggcagcaaaggaattcattgcttggctggtgaaaggccgaggaaggcgagacttcccagaagaagtcgccattgccgaggaactcggccgcaggcacgctgatggctccttctctgacgagatgagcaccattctggataatcttgccaccagggacttcatcaactggctgattcaaaccaagatcactgacaagaaatag

SEQ ID NO: 10 - DNA, 543 bp, Homo sapiens
atgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataa

SEQ ID NO: 11 - DNA, 297 bp, Mus musculus
atggtggcggtgcgcaggccttggcccgtcacggtcgcaatgctgctaatcctgctcgcctgtctgggagccctggtggacgcctaccctgccaaaccagaggctcccggcgaagacgcctccccggaggagctgagccgctactacgcctccctgcgccactacctcaacctggtcacccggcagcggtatggaaaaagagatgtccccgcagctctgttctccaaactgctcttcacagacgacagcgacagcgagaacctccccttcaggccagaaggtttggaccagtggtga

SEQ ID NO: 12 - DNA, 294 bp, Homo sapiens
atggtgttcgtgcgcaggccgtggcccgccttgaccacagtgcttctggccctgctcgtctgcctaggggcgctggtcgacgcctaccccatcaaacccgaggctcccggcgaagacgcctcgccggaggagctgaaccgctactacgcctccctgcgccactacctcaacctggtcacccggcagcggtatgggaaaagagacggcccggacacgcttctttccaaaacgttcttccccgacggcgaggaccgccccgtcaggtcgcggtcggagggcccagacctgtggtga

SEQ ID NO: 13 - DNA, 294 bp, Mus musculus
atgctaggtaacaagcgaatggggctgtgtggactgaccctcgctctatctctgctcgtgtgtttgggcattctggctgaggggtacccctccaagccggacaatccgggcgaggacgcgccagcagaggacatggccagatactactccgctctgcgacactacatcaatctcatcaccagacagagatatggcaagagatccagccctgagacactgatttcagacctcttaatgaaggaaagcacagaaaacgcccccagaacaaggcttgaagacccttccatgtggtga

SEQ ID NO: 14 - DNA, 294 bp, Homo sapiens
atgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtga

SEQ ID NO: 15 - DNA, 303 bp, Mus musculus
atggccgtcgcatactgctgcctctccctgtttctcgtatccacttgggtggctctgctgctgcagcccctgcaggggacctggggagcccccctggagccaatgtacccaggcgactatgcgacacctgagcagatggcacaatatgaaactcagctccgcagatacatcaacacactgaccaggcctaggtatgggaagagagccgaggaggagaacacaggtggacttcctggagtgcagctctccccctgcaccagccccccagttggcttgattccctgctctgcgccctggagctga

SEQ ID NO: 16 - DNA, 288 bp, Homo sapiens
atggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtatgggaaaagacacaaagaggacacgctggccttctcggagtgggggtccccgcatgctgctgtccccagggagctcagcccgctggacttataa

SEQ ID NO: 17 - DNA, 351 bp, Mus musculus
atgctgtcctgccgtctccagtgcgccctggctgcgctctgcatcgtcctggctttgggcggtgtcaccggcgcgccctcggaccccagactccgtcagtttctgcagaagtctctggcggctgccaccgggaaacaggaactggccaagtacttcttggcagagctgctgtccgagcccaaccagacagagaatgatgccctggagcccgaggatttgccccaggcagctgagcaggacgagatgaggctggagctgcagaggtctgccaactcgaacccagcaatggcaccccgggaacgcaaagctggctgcaagaacttcttctggaagacattcacatcctgttag

SEQ ID NO: 18 - DNA, 351 bp, Homo sapiens
atgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttag

SEQ ID NO: 19 - DNA, 312 bp, Mus musculus
atgctgctctgggtgctctttgtgatcctcatcctcaccagtggctcccactgctcactgcccccctcacctcccttcaggatgcagcgacacgtagatgccatcttcaccaccaactacaggaaactcctgagccagctgtatgcccggaaagtgatccaggacatcatgaacaagcaaggggagaggatccaggaacaaagggccaggctcagccgccaggaagacagcatgtggacagaggacaagcagatgaccctggagagcatcttgcagggattcccaaggatgaagccttcagcggacgcttga

SEQ ID NO: 20 - DNA, 324 bp, Homo sapiens
atgccactctgggtgttcttctttgtgatcctcaccctcagcaacagctcccactgctccccacctccccctttgaccctcaggatgcggcggtatgcagatgccatcttcaccaacagctaccggaaggtgctgggccagctgtccgcccgcaagctgctccaggacatcatgagcaggcagcagggagagagcaaccaagagcgaggagcaagggcacggcttggtcgtcaggtagacagcatgtgggcagaacaaaagcaaatggaattggagagcatcctggtggccctgctgcagaagcacaggaactcccagggatga

SEQ ID NO: 21 - DNA, 708 bp, Mus musculus
atgccgagattctgctacagtcgctcaggggccctgttgctggccctcctgcttcagacctccatagatgtgtggagctggtgcctggagagcagccagtgccaggacctcaccacggagagcaacctgctggcttgcatccgggcttgcaaactcgacctctcgctggagacgcccgtgtttcctggcaacggagatgaacagcccctgactgaaaacccccggaagtacgtcatgggtcacttccgctgggaccgcttcggccccaggaacagcagcagtgctggcagcgcggcgcagaggcgtgcggaggaagaggcggtgtggggagatggcagtccagagccgagtccacgcgagggcaagcgctcctactccatggagcacttccgctggggcaagccggtgggcaagaaacggcgcccggtgaaggtgtaccccaacgttgctgagaacgagtcggcggaggcctttcccctagagttcaagagggagctggaaggcgagcggccattaggcttggagcaggtcctggagtccgacgcggagaaggacgacgggccctaccgggtggagcacttccgctggagcaacccgcccaaggacaagcgttacggtggcttcatgacctccgagaagagccagacgcccctggtgacgctcttcaagaacgccatcatcaagaacgcgcacaagaagggccagtga

SEQ ID NO: 22 - DNA, 804 bp, Homo sapiens
atgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtga

SEQ ID NO: 23 - DNA, 378 bp, Mus musculus
atggcctgccccagtctcgcttgctgcctgcttggcttactggctctgacctcggcctgctacatccagaactgccccctgggcggcaagagggctgtgctggacctggatatgcgcaagtgtctcccctgcggcccgggcggcaaaggacgctgcttcggaccaagcatctgctgcgcggacgagctgggctgcttcgtgggcaccgccgaggcgctgcgctgccaggaggagaactacctgccttcgccctgccagtctggccagaagccctgcgggagcggaggccgctgcgccgccacaggcatctgctgcagcccggatggctgccgcacagaccccgcctgcgaccctgagtctgccttctcggagcgctga

SEQ ID NO: 24 - DNA, 378 bp, Homo sapiens
atggccggccccagcctcgcttgctgtctgctcggcctcctggcgctgacctccgcctgctacatccagaactgccccctgggaggcaagagggccgcgccggacctcgacgtgcgcaagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccggacggctgccacgccgaccctgcctgcgacgcggaagccaccttctcccagcgctga

SEQ ID NO: 25 - DNA, 507 bp, Mus musculus
atgctcgccaggatgctcaacactacgctctccgcttgtttcctgagcctgctggccttctcctccgcctgctacttccagaactgcccaagaggcggcaagagggccatctctgacatggagctgagacagtgtctcccctgcggcccgggcggcaaaggacgctgcttcggaccaagcatctgctgcgcggacgagctgggctgcttcgtgggcaccgccgaggcgctgcgctgccaggaggagaactacctgccctcgccctgccagtccggccagaagccctgcgggagcgggggccgctgcgccgccgtgggcatctgctgcagcgacgagagctgcgtggccgagcccgagtgccacgacggttttttccgcctcacccgcgctcgggagccaagcaacgccacacagctggacggccctgctcgggcgctgctgctaaggctggtacagctggctgggacacgggagtccgtggattctgccaagccccgggtctactga

SEQ ID NO: 26 - DNA, 495 bp, Homo sapiens
atgcctgacaccatgctgcccgcctgcttcctcggcctactggccttctcctccgcgtgctacttccagaactgcccgaggggcggcaagagggccatgtccgacctggagctgagacagtgcctcccctgcggccccgggggcaaaggccgctgcttcgggcccagcatctgctgcgcggacgagctgggctgcttcgtgggcacggctgaggcgctgcgctgccaggaggagaactacctgccgtcgccctgccagtccggccagaaggcgtgcgggagcgggggccgctgcgccgccttcggcgtttgctgcaacgacgagagctgcgtgaccgagcccgagtgccgcgagggctttcaccgccgcgcccgcgccagcgaccggagcaacgccacgcagctggacgggccggccggggccttgctgctgcggctggtgcagctggccggggcgcccgagcccttcgagcccgcccagcccgacgcctactga

SEQ ID NO: 27 - DNA, 273 bp, Mus musculus
atgatcctcaaactgatggccggcattctactgctgactgtgtgtttggaaggctgctccagccagcactggtcctatgggttgcgccctgggggaaagagaaacactgaacacttggttgagtctttccaagagatgggcaaggaggtggatcaaatggcagaaccccagcacttcgaatgtactgtccactggccccgttcacccctcagggatctgcgaggagctctggaaagtctgattgaagaggaagccaggcagaagaagatgtag

SEQ ID NO: 28 - DNA, 279 bp, Homo sapiens
atgaagccaattcaaaaactcctagctggccttattctactgacttggtgcgtggaaggctgctccagccagcactggtcctatggactgcgccctggaggaaagagagatgccgaaaatttgattgattctttccaagagatagtcaaagaggttggtcaactggcagaaacccaacgcttcgaatgcaccacgcaccagccacgttctcccctccgagacctgaaaggagctctggaaagtctgattgaagaggaaactgggcagaagaagatttaa

SEQ ID NO: 29 - DNA, 417 bp, Mus musculus
atgagtgctgccgtcctcctctccgtgctttttgctcttgcttgtgggcaagcagcatccttttgtattcccactgagtatacaatgtacgtggataggagagagtgtgcctactgcctgaccatcaacaccaccatctgtgctgggtattgtatgacacgggatatcaatggcaaactgtttcttcccaaatatgcactctctcaggatgtctgtacatacagagacttcatctacagaacggtggaaataccaggatgcccgcaccatgttactccttatttctccttccctgtcgccataagctgcaagtgtggcaagtgtaatactgacaacagtgactgcatacacgaggctgtcagaaccaactactgcaccaagccgcagtctttctatctggggggattttctgtttaa

SEQ ID NO: 30 - DNA, 417 bp, Homo sapiens
atgactgctctctttctgatgtccatgctttttggccttacatgtgggcaagcgatgtctttttgtattccaactgagtatacaatgcacatcgaaaggagagagtgtgcttattgcctaaccatcaacaccaccatctgtgctggatattgtatgacacgggatatcaatggcaaactgtttcttcccaaatatgctctgtcccaggatgtttgcacatatagagacttcatctacaggactgtagaaataccaggatgcccactccatgttgctccctatttttcctatcctgttgctttaagctgtaagtgtggcaagtgcaatactgactatagtgactgcatacatgaagccatcaagacaaactactgtaccaaacctcagaagtcttatctggtaggattttctgtctaa

SEQ ID NO: 31 - DNA, 564 bp, Mus musculus
atgcggctgcggctgctggtgtccgcgggcatgctgctggtggctctgtcgtcctgcctgccttgcagggccctgctcagcaggggatccgtcccccgagcgccgcgggccccgcagcccttgaatttcttgcagccggagcagccccagcaacctcagccggttctgatccgcatgggtgaagaatacttcctccgcctggggaatctcaacagaagtcccgctgctcggctgtcccccaactccacgcccctcaccgcgggtcgcggcagccgcccctcgcacgaccaggctgcggctaactttttccgcgtgttgctgcagcagctgcagatgcctcagcgctcgctcgacagccgcgcggagccggccgaacgcggcgccgaggatgccctcggtggccaccagggggcgctggagagggagaggcggtcggaggagccgcccatctctctggatctcaccttccaccttctgcgggaagtcttggaaatggcccgggcagagcagttagctcagcaagctcacagcaacaggaaactgatggagattatcgggaaatga

SEQ ID NO: 32 - DNA, 591 bp, Homo sapiens
atgcggctgccgctgcttgtgtccgcgggagtcctgctggtggctctcctgccctgcccgccatgcagggcgctcctgagccgcgggccggtcccgggagctcggcaggcgccgcagcaccctcagcccttggatttcttccagccgccgccgcagtccgagcagccccagcagccgcaggctcggccggtcctgctccgcatgggagaggagtacttcctccgcctggggaacctcaacaagagcccggccgctcccctttcgcccgcctcctcgctcctcgccggaggcagcggcagccgcccttcgccggaacaggcgaccgccaactttttccgcgtgttgctgcagcagctgctgctgcctcggcgctcgctcgacagccccgcggctctcgcggagcgcggcgctaggaatgccctcggcggccaccaggaggcaccggagagagaaaggcggtccgaggagcctcccatctccctggatctcaccttccacctcctccgggaagtcttggaaatggccagggccgagcagttagcacagcaagctcacagcaacaggaaactcatggagattattgggaaataa

SEQ ID NO: 33 - DNA, 459 bp, Mus musculus
atgggctccttctccatcaccctgggcttcttcctcgtcttggccttttggcttccaggccatattggagcaaatcctgtgtacagtgcggtgtccaacacagatctgatggatttcaagaacctgctagaccacctggaggagaagatgccggtagaagatgaggtcatgcccccgcaggccctgagtgagcagactgaggaagcaggggccgcacttagctccctccccgaggtgcctccctggactggggaggtcaacccacctctgagagacggcagtgctctagggcgcagcccctgggacccctccgatagatctgccctcttgaaaagcaaactgagggctctgctcgctggccctcggagcctacgaagatccagctgcttcgggggtaggattgacaggattggagcccagagtggactaggctgcaacagcttccggtaccgaagataa

SEQ ID NO: 34 - DNA, 456 bp, Homo sapiens
atgagctccttctccaccaccaccgtgagcttcctccttttactggcattccagctcctaggtcagaccagagctaatcccatgtacaatgccgtgtccaacgcagacctgatggatttcaagaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtactga

SEQ ID NO: 35 - DNA, 366 bp, Mus musculus
atggatctcctgaaggtgctgtcccagatgattctgtttctgcttttcctttatctgtcaccgctgggaggtcactcctatcctctgggaagtcctagccagtctccagagcaattcaagatgcagaagctgctggagctgataagagaaaagtcggaggaaatggcccagagacagctcttgaaggaccaaggcctcacaaaagaacacccaaaaagagtccttcggtctcaaggcagcaccctccgggtccagcagagacctcaaaattccaaggtgacacatatctcaagctgctttgggcacaagatagaccggatcggatccgtcagtcgtttgggctgtaacgcactgaagttgttgtag

SEQ ID NO: 36 - DNA, 405 bp, Homo sapiens
atggatccccagacagcaccttcccgggcgctcctgctcctgctcttcttgcatctggctttcctgggaggtcgttcccacccgctgggcagccccggttcagcctcggacttggaaacgtccgggttacaggagcagcgcaaccatttgcagggcaaactgtcggagctgcaggtggagcagacatccctggagcccctccaggagagcccccgtcccacaggtgtctggaagtcccgggaggtagccaccgagggcatccgtgggcaccgcaaaatggtcctctacaccctgcgggcaccacgaagccccaagatggtgcaagggtctggctgctttgggaggaagatggaccggatcagctcctccagtggcctgggctgcaaagtgctgaggcggcattaa

SEQ ID NO: 37 - DNA, 1209 bp, Mus musculus
atggacagaaggaggatgcctctctgggcactcttgttgctctggagtccttgcaccttcagtctcccaacacgcaccgctacctttgaacgaatcccgctcaagaaaatgccttctgtccgggaaatcctggaggagcggggagtggacatgaccaggctcagtgctgaatggggcgtattcacaaagaggccttccttgaccaatcttacctcccccgtggtcctcaccaactacctgaatacccagtactacggcgagattggcatcggtaccccaccccagaccttcaaagtcatctttgacacgggttcagccaacctctgggtgccctccaccaagtgcagccgcctctaccttgcttgtgggattcacagcctctatgagtcctctgactcctccagctacatggagaacgggtccgacttcaccatccactacggatcagggagagtcaaaggtttcctcagccaggactcggtgactgtgggtggaatcactgtgacacagacctttggagaggtcaccgagctgcccctgatccctttcatgctggccaagtttgacggtgttctaggcatgggctttcccgctcaggccgttggcggggttacccctgtctttgaccacattctctcccagggggtgctaaaggaggaagtgttctctgtctactacaacaggggttcccacctgctggggggcgaggtggtgctaggaggtagcgacccgcagcattatcaaggcaattttcactatgtgagcatcagcaagactgactcctggcagatcacgatgaagggggtgtctgtggggtcttccaccctgctatgtgaagaaggctgtgcggtagtggtggacactggttcatcctttatctcggctcctacgagctccctgaagttgatcatgcaagccctgggagccaaggagaagagaatagaagaatatgttgtgaactgtagccaggtgcccaccctccccgacatttcctttgacctgggaggcagggcctacacactcagcagtacggactacgtgctacagtatcccaacaggagagacaagctgtgcacactggctctccatgccatggacatcccaccacccactgggcctgtctgggtcctgggtgccaccttcatccgcaagttctatacagagtttgatcggcataacaatcgcattggattcgccttggcccgctaa

SEQ ID NO: 38 - DNA, 1221 bp, Homo sapiens
atggatggatggagaaggatgcctcgctggggactgctgctgctgctctggggctcctgtacctttggtctcccgacagacaccaccacctttaaacggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattggcatcggcaccccaccccagaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacagagattccgagaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctga

SEQ ID NO: 39 - DNA, 375 bp, Mus musculus
atggccagaggcagcgttatcctgctaggctggctcctgttggttgtgaccctgtcagccactctgggacttgggatgcctgcaaaggagaagagaggttggaccctgaacagcgctggctaccttctgggcccacatgccattgacaaccacagatcatttagcgacaagcatggcctcacaggcaagagggagttacaactggaggtggaggaaaggagaccaggaagtgttgatgtgcccctgcctgagagcaacattgtccgcactataatggagtttctcagtttcttgcaccttaaagaggccggggccctcgacagcctgcctggcatccccttggccacctcctcagaagacctagagaagtcctga

SEQ ID NO: 40 - DNA, 372 bp, Homo sapiens
atggcccgaggcagcgccctcctgctcgcctccctcctcctcgccgcggccctttctgcctctgcggggctctggtcgccggccaaggaaaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctga

SEQ ID NO: 41 - DNA, 393 bp, Mus musculus
atgaactttccttctacaaaggttccctgggccgccgtgacgctgctgctgctgctactgctgccgccggcgctgctgtcgcttggggtggacgcacagcctctgcccgactgctgtcgccagaagacgtgttcctgccgtctctacgaactgttgcacggagctggcaaccacgctgcgggtatcctgactctgggaaagcggcggcctggacctccaggcctccagggacggctgcagcgcctccttcaggccaacggtaaccacgcagctggcatcctgaccatgggccgccgcgcaggcgcagagctagagccacatccctgctctggtcgcggctgtccgaccgtaactaccaccgctttagcaccccggggagggtccggagtctga

SEQ ID NO: 42 - DNA, 396 bp, Homo sapiens
atgaaccttccttccacaaaggtctcctgggccgccgtgacgctactgctgctgctgctgctgctgccgcccgcgctgttgtcgtccggggcggctgcacagcccctgcccgactgctgtcgtcaaaagacttgctcttgccgcctctacgagctgctgcacggcgcgggcaatcacgcggccggcatcctcacgctgggcaagcggaggtccgggcccccgggcctccagggtcggctgcagcgcctcctgcaggccagcggcaaccacgccgcgggcatcctgaccatgggccgccgcgcaggcgcagagccagcgccgcgcccctgcctcgggcgccgctgttccgccccggccgccgcctccgtcgcgcccggaggacagtccgggatctga

SEQ ID NO: 43 - DNA, 354 bp, Mus musculus
atgctgtcttcaggcaccatctgcagtttgctgctactcagcatgctctggatggacatggccatggcaggctccagcttcctgagcccagagcaccagaaagcccagcagagaaaggaatccaagaagccaccagctaaactgcagccacgagctctggaaggctggctccacccagaggacagaggacaagcagaagagacagaggaggagctggagatcaggttcaatgctcccttcgatgttggcatcaagctgtcaggagctcagtatcagcagcatggccgggccctggggaagtttcttcaggatatcctctgggaagaggtcaaagaggcgccagctgacaagtaa

SEQ ID NO: 44 - DNA, 351 bp, Homo sapiens
atgccctccccagggaccgtctgcagcctcctgctcctcggcatgctctggctggacttggccatggcaggctccagcttcctgagccctgaacaccagagagtccagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtga

SEQ ID NO: 45 - DNA, 348 bp, Mus musculus
atgaagagcggcgtatgtctgtgcgtggtgatggcagtcctagctgctggcgccctggcgcagccggtagtccctgcagaagctacggaccccgtggagcagcgggcgcaagaggcgccccgaaggcagctgcgggctgtgctccggacggacggcgagccccgagcgcgcctgggcgcactgctagcgcgatacatccagcaggtccgcaaagctccttctggccgcatgtccgttcttaagaacctgcagagcctggaccccagccatagaataagtgaccgggactacatgggctggatggattttggccggcgcagtgccgaggactacgaatacccatcgtag

SEQ ID NO: 46 - DNA, 348 bp, Homo sapiens
atgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctag

SEQ ID NO: 47 - DNA, 306 bp, Mus musculus
atgcctcgactgtgtgtgtacatgctggtcttagtgctggctctagctaccttctcggaagcttcttggaagccccgctcccagctacaggatgcatcatctggaccagggaccaatgaggacctggaacagcgccagttcaacaagctgggctcagcctctcaccatcgaaggcagctggggccccagggtcctcaacacttcatagcagacctgtccaagaagcagaggccacgaatggaggaagaagaagaggcctacggatggatggactttggccgccgcagtgctgaggaagaccagtag

SEQ ID NO: 48 - DNA, 306 bp, Homo sapiens
atgcagcgactatgtgtgtatgtgctgatctttgcactggctctggccgccttctctgaagcttcttggaagccccgctcccagcagccagatgcacccttaggtacaggggccaacagggacctggagctaccctggctggagcagcagggcccagcctctcatcatcgaaggcagctgggaccccagggtcccccacacctcgtggcagacccgtccaagaagcagggaccatggctggaggaagaagaagaagcctatggatggatggacttcggccgccgcagtgctgaggatgagaactaa

SEQ ID NO: 49 - DNA, 393 bp, Mus musculus
atgaaaatcctcgtggccgtggcggtcttttttctcgtttccactcaactgtttgcagaggaaatcgatgccaacgatgatctaaattattggtccgactggtccgacagtgaccagatcaaggaggcaatgccggagccctttgagcatcttctgcagagaatcgcccgaagacccaagcctcagcagttctttggattaatgggcaagcgggatgctgattcctcagttgaaaaacaagtggccctgttaaaggctctttatggacatggccagatctctcacaaaaggcataaaacagattcctttgttggactaatgggcaaaagagctttaaattctgtggcttatgaaagaagcgcgatgcagaactacgaaagaagacgtaaataa

SEQ ID NO: 50 - DNA, 390 bp, Homo sapiens
atgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaa

SEQ ID NO: 51 - DNA, 807 bp, Mus musculus
atggcgcggttcctgaggctttgcacctggctgctggcgcttgggtcctgcctcctggctacagtgcaggcggaatgcagccaggactgcgctaaatgcagctaccgcctggttcgcccaggcgacatcaatttcctggcgtgcacactggaatgtgaaggacagctgccttctttcaaaatctgggagacctgcaaggatctcctgcaggtgtccaggcccgagttcccttgggataacatcgacatgtacaaagacagcagcaaacaggatgagagccacttgctagccaagaagtacggaggcttcatgaaacggtacggaggcttcatgaagaagatggacgagctatatcccatggagccagaagaagaagcgaacggaggagagatccttgccaagaggtatggcggcttcatgaagaaggatgcagatgagggagacaccttggccaactcctccgatctgctgaaagagctactgggaacgggagacaaccgtgcgaaagacagccaccaacaagagagcaccaacaatgacgaagacatgagcaagaggtatgggggcttcatgagaagcctcaaaagaagcccccaactggaagatgaagcaaaagagctgcagaagcgctacgggggcttcatgagaagggtgggacgccccgagtggtggatggactaccagaagaggtatgggggcttcctgaagcgctttgctgagtctctgccctccgatgaagaaggcgaaaattactcgaaagaagttcctgagatagagaaaagatacgggggctttatgcggttctga

SEQ ID NO: 52 - DNA, 804 bp, Homo sapiens
atggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaa

SEQ ID NO: 53 - DNA, 747 bp, Mus musculus
atggcgtggtccaggctgatgctggcagcttgcctcctcgtgatgccctctaatgttatggcggactgcctgtccctgtgctccctgtgtgcagtgaggattcaggatgggccccgtcccatcaaccccctgatttgctccctggagtgccaggacctggtgccgccctcagaggagtgggagacatgccggggcttctcatcttttctcaccctgacggtctctgggctccgtggcaaggatgacttggaagatgaggttgctttggaagaaggctacagtgcactagccaagctcttggaacccgtcctgaaggagctggagaaaagccgactccttaccagcgtcccagaggaaaagttcaggggtctctccagcagctttggcaacggaaaagaatctgagctggcgggtgctgaccggatgaatgatgaagccgcacaggcgggcacgctccattttaatgaggaggacttgagaaaacaggccaaacgctatggcggctttttgcgcaaataccccaagaggagttccgagatggcccgggatgaggacgggggccaggatggggatcaggtagggcatgaggacctgtacaaacgctatgggggcttcctgcggcgcattcgccccaagctgaagtgggacaaccagaagcgctatggtggtttcctgcggcgtcagttcaaggtggtgacgcggtcccaggagaaccccaatacctattctgaagatttagatgtttga

SEQ ID NO: 54 - DNA, 765 bp, Homo sapiens
atggcctggcaggggctggtcctggctgcctgcctcctcatgttcccctccaccacagcggactgcctgtcgcggtgctccttgtgtgctgtaaagacccaggatggtcccaaacctatcaatcccctgatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataa

SEQ ID NO: 55 - DNA, 480 bp, Mus musculus
atggggaaaatcagcagccttccaactcaattatttaagatctgcctctgtgacttcttgaagataaagatacacatcatgtcgtcttcacacctcttctacctggcgctctgcttgctcaccttcaccagctccaccacagctggaccagagaccctttgcggggctgagctggtggatgctcttcagttcgtgtgtggaccgaggggcttttacttcaacaagcccacaggctatggctccagcattcggagggcacctcagacaggcattgtggatgagtgttgcttccggagctgtgatctgaggagactggagatgtactgtgccccactgaagcctacaaaagcagcccgctctatccgtgcccagcgccacactgacatgcccaagactcagaagtccccgtccctatcgacaaacaagaaaacgaagctgcaaaggagaaggaaaggaagtacatttgaagaacacaagtag

SEQ ID NO: 56 - DNA, 477 bp, Homo sapiens
atgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtag

SEQ ID NO: 57 - DNA, 576 bp, Mus musculus
atgggcggcagcgtcgccggcttccaggtaccaatggggatcccagtggggaagtcgatgttggtgcttctcatctctttggccttcgccttgtgctgcatcgctgcttacggccccggagagactctgtgcggaggggagcttgttgacacgcttcagtttgtctgttcggaccgcggcttctacttcagcaggccttcaagccgtgccaaccgtcgcagccgtggcatcgtggaagagtgctgcttccgcagctgcgacctggccctcctggagacatactgtgccacccccgccaagtccgagagggacgtgtctacctctcaggccgtacttccggacgacttccccagataccccgtgggcaagttcttccaatatgacacctggagacagtccgcgggacgcctgcgcagaggcctgcctgccctcctgcgtgcccgccggggtcgcatgcttgccaaagagctcaaagagttcagagaggccaaacgtcatcgtcccctgatcgtgttaccacccaaagaccccgcccacgggggagcctcttcggagatgtccagcaaccatcagtga

SEQ ID NO: 58 - DNA, 543 bp, Homo sapiens
atgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtga

SEQ ID NO: 59 - DNA, 348 bp, Mus musculus
atgatgtctgcaaacaccgtggctaaagtgatgatcatcatgctggcagtctgtcttcttacccaaacggatgggaaacccgtgaggaagagagctgtcagtgaaatacagcttatgcacaacctgggcaaacacctggcctccatggagaggatgcaatggctgagaaggaagctgcaagatatgcacaattttgttagtcttggagtccaaatggctgccagagatggcagtcaccagaagcccaccaagaaggaggaaaatgtccttgttgatggcaatccaaaaagtcttggtgagggagacaaagctgatgtggatgtattagttaaatcaaaatctcagtaa

SEQ ID NO: 60 - DNA, 348 bp, Homo sapiens
atgatacctgcaaaagacatggctaaagttatgattgtcatgttggcaatttgttttcttacaaaatcggatgggaaatctgttaagaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttcccagaggccccgaaaaaaggaagacaatgtcttggttgagagccatgaaaaaagtcttggagaggcagacaaagctgatgtgaatgtattaactaaagctaaatcccagtga

SEQ ID NO: 61 - DNA, 528 bp, Mus musculus
atgctgcggaggctggttcagcagtggagtgtcctggtattcctgctcagctactccgtgccctcccgcgggcgttcggtggaggggcttggccgcaggctcaaacgcgctgtgtctgaacatcagctactgcatgacaagggcaagtccatccaagacttgcgccgccgtttcttcctccaccatctgatcgcggagatccacacagccgaaatcagagctacctcggaggtgtcccccaactccaaacctgctcccaacaccaaaaaccaccccgtgcggtttgggtcagacgatgagggcagatacctaactcaggaaaccaacaaggtggagacgtacaaagaacagccactcaagacacccgggaagaagaagaaaggcaagcctgggaaacgcagagaacaggagaaaaagaagcgaaggactcggtctgcctggccaagcacagctgcgagtggcctgcttgaggaccccctgccccacacctccaggccctcgctggagcccagcttaaggacgcattga

SEQ ID NO: 62 - DNA, 534 bp, Homo sapiens
atgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattga

SEQ ID NO: 63 - DNA, 288 bp, Mus musculus
atgaggaccatctttctgctcactctgctgaccctggctgcgctctgtctctctgacctcacagatgccaagcccagcggccctgagtctgacaaagccttcatgtccaagcaggagggcaataaggtagtgaacagactccggcgctaccttggagcctcagtccccagcccagatcccctggagcccacccgggagcagtgtgagcttaaccctgcttgtgacgagctatcagaccagtatggcttgaagaccgcctacaaacgcatctatggtatcactatttag

SEQ ID NO: 64 - DNA, 303 bp, Homo sapiens
atgagagccctcacactcctcgccctattggccctggccgcactttgcatcgctggccaggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctag

SEQ ID NO: 65 - DNA, 495 bp, Mus musculus
atgctgatgcccacctacttcctgctgccacttctgctgctcctaggaggtccaaggacaagcctctcccacaagttctacaacactggaccagtcttcagctgcctcaacacagccctatctgaggtcaagaagaacaagctggaagatgtgcccttgctgagcaagaagagctttggccacctgcccacacaagacccctcaggggaagaagatgacaaccaaacgcacctccagatcaaaagaactttctcaggtgccgcgggtgggaatggagctgggagcacccggtacagataccaatcccaggcacagcacaaggggaagctgtacccagacaagcccaaaagcgaccggggcaccaagttcaccctttcccttgatgttcccactaacatcatgaacatcctcttcaacatcgacaaggccaagaatttgcgagccaaggcagctgccaatgctcagctcatggcacagattgggaagaagaagtaa

SEQ ID NO: 66 - DNA, 486 bp, Homo sapiens
atgctgatgccggtccacttcctgctgctcctgctgctgctcctggggggccccaggacaggcctcccccacaagttctacaaagccaagcccatcttcagctgcctcaacaccgccctgtctgaggctgagaagggccagtgggaggatgcatccctgctgagcaagaggagcttccactacctgcgcagcagagacgcctcttcgggagaggaggaggagggcaaagagaaaaagactttccccatctctggggccaggggtggagccagaggcacccggtacagatacgtgtcccaagcacagcccaggggaaagccacgccaggacacggccaagagtccccaccgcaccaagttcaccctgtccctcgacgtccccaccaacatcatgaacctcctcttcaacatcgccaaggccaagaacctgcgtgcccaggcggccgccaatgcccacctgatggcgcaaattgggaggaagaagtag

SEQ ID NO: 67 - DNA, 342 bp, Mus musculus
atgatgaccaggtgggcactggtggtgttcgtggtcctgatgttggataggatcctatttgtcccaggaactcctatccccaccttccagctcctccctcagaactctctggagacaactcctagctctgtgacctcagagagctcctcaggtaccaccacaggaccctcagcttcctggagcaactctaaagccagcccttacctagacacccgtgtcatactctccctggatgttcccattggcctcctacggatcttactggaacaggctcgttacaaggctgccaggaatcaggctgccactaatgctcaaatactagcccatgttggccgccgctga

SEQ ID NO: 68 - DNA, 339 bp, Homo sapiens
atgaccaggtgtgctctgctgttgctgatggtcctgatgttgggcagagtcctggttgtcccagtgacccctatcccaaccttccagctccgccctcagaattctccccagaccactccccgacctgcggcctcagagagcccctcagctgctcccacatggccgtgggctgcccagagccactgcagccccacccgccaccctggctcgcgcattgtcctatcgctggatgtccccatcggcctcttgcagatcttactggagcaagcccgggccagggctgccagggagcaggccaccaccaacgcccgcatcctggcccgtgtcggccactgctga

SEQ ID NO: 69 - DNA, 369 bp, Mus musculus
atgatacagaggggacgcgctacgctcctggtggcgttgctgctcttggcacagcttcgcccggagagcagccagtggagcccagcggctgcggcggcaactggggtccaggatccgaatctgcgatggagccctggagtgcggaatcagggcggcggcgtccgcgcgctcctcttgctgttagcggagcgcttcccgcgccgcgcaggatctgagcctgcgggcgagcggcagcgacgggacgaccctccactgtccatcgacctcaccttccacctgctgcggaccctgctggagctagctcggacacagagccagcgcgagcgcgcagagcagaaccgcatcatattcgattcggtgggcaagtga

SEQ ID NO: 70 - DNA, 375 bp, Homo sapiens
atgaggcaggcgggacgcgcagcgctgctggccgcgctgctgctcctggtacagctgtgccctgggagcagccagaggagccccgaggcggccggggtccaggacccgagtctgcgctggagccccggggcacggaaccagggtggcggggcccgcgcgctcctcttgctgctggcggagcgcttcccgcgccgcgcggggcccggccgattgggactcgggacggcaggcgagcggccgcggcgggacaacccttctctgtccattgacctcacctttcacctgctgcggaccctgctggagctggcgcggacgcagagccagcgggagcgcgccgagcagaaccgcatcatattcgactcggtgggcaagtga

SEQ ID NO: 71 - DNA, 756 bp, Mus musculus
atgctagggacctgccttagactcctggtgggcgtgctctgcactgtctgcagcttgggcactgctagagcctatccggacacttccccattgcttggctccaactggggaagcctgacccacctgtacacggctacagccaggaccagctatcacctacagatccatagggatggtcatgtagatggcaccccccatcagaccatctacagtgccctgatgattacatcagaggacgccggctctgtggtgataacaggagccatgactcgaaggttcctttgtatggatctccacggcaacatttttggatcgcttcacttcagcccagagaattgcaagttccgccagtggacgctggagaatggctatgacgtctacttgtcgcagaagcatcactacctggtgagcctgggccgcgccaagcgcatcttccagccgggcaccaacccgccgcccttctcccagttcctggctcgcaggaacgaggtcccgctgctgcatttctacactgttcgcccacggcgccacacgcgcagcgccgaggacccaccggagcgcgacccactgaacgtgctcaagccgcggccccgcgccacgcctgtgcctgtatcctgctctcgcgagctgccgagcgcagaggaaggtggccccgcagccagcgatcctctgggggtgctgcgcagaggccgtggagatgctcgcgggggcgcgggaggcgcggataggtgtcgcccctttcccaggttcgtctag

SEQ ID NO: 72 - DNA, 756 bp, Homo sapiens
atgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgccctgatgatcagatcagaggatgctggctttgtggtgattacaggtgtgatgagcagaagatacctctgcatggatttcagaggcaacatttttggatcacactatttcgacccggagaactgcaggttccaacaccagacgctggaaaacgggtacgacgtctaccactctcctcagtatcacttcctggtcagtctgggccgggcgaagagagccttcctgccaggcatgaacccacccccgtactcccagttcctgtcccggaggaacgagatccccctaattcacttcaacacccccataccacggcggcacacccggagcgccgaggacgactcggagcgggaccccctgaacgtgctgaagccccgggcccggatgaccccggccccggcctcctgttcacaggagctcccgagcgccgaggacaacagcccgatggccagtgacccattaggggtggtcaggggcggtcgagtgaacacgcacgctgggggaacgggcccggaaggctgccgccccttcgccaagttcatctag

SEQ ID NO: 73 - DNA, 810 bp, Mus musculus
atggcaactgttcctgaactcaactgtgaaatgccaccttttgacagtgatgagaatgacctgttctttgaagttgacggaccccaaaagatgaagggctgcttccaaacctttgacctgggctgtcctgatgagagcatccagcttcaaatctcgcagcagcacatcaacaagagcttcaggcaggcagtatcactcattgtggctgtggagaagctgtggcagctacctgtgtctttcccgtggaccttccaggatgaggacatgagcaccttcttttccttcatctttgaagaagagcccatcctctgtgactcatgggatgatgatgataacctgctggtgtgtgacgttcccattagacaactgcactacaggctccgagatgaacaacaaaaaagcctcgtgctgtcggacccatatgagctgaaagctctccacctcaatggacagaatatcaaccaacaagtgatattctccatgagctttgtacaaggagaaccaagcaacgacaaaatacctgtggccttgggcctcaaaggaaagaatctatacctgtcctgtgtaatgaaagacggcacacccaccctgcagctggagagtgtggatcccaagcaatacccaaagaagaagatggaaaaacggtttgtcttcaacaagatagaagtcaagagcaaagtggagtttgagtctgcagagttccccaactggtacatcagcacctcacaagcagagcacaagcctgtcttcctgggaaacaacagtggtcaggacataattgacttcaccatggaatccgtgtcttcctaa

SEQ ID NO: 74 - DNA, 810 bp, Homo sapiens
atggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaa

SEQ ID NO: 75 - DNA, 708 bp, Mus musculus
atgagcacagaaagcatgatccgcgacgtggaactggcagaagaggcactcccccaaaagatggggggcttccagaactccaggcggtgcctatgtctcagcctcttctcattcctgcttgtggcaggggccaccacgctcttctgtctactgaacttcggggtgatcggtccccaaagggatgagaagttcccaaatggcctccctctcatcagttctatggcccagaccctcacactcagatcatcttctcaaaattcgagtgacaagcctgtagcccacgtcgtagcaaaccaccaagtggaggagcagctggagtggctgagccagcgcgccaacgccctcctggccaacggcatggatctcaaagacaaccaactagtggtgccagccgatgggttgtaccttgtctactcccaggttctcttcaagggacaaggctgccccgactacgtgctcctcacccacaccgtcagccgatttgctatctcataccaggagaaagtcaacctcctctctgccgtcaagagcccctgccccaaggacacccctgagggggctgagctcaaaccctggtatgagcccatatacctgggaggagtcttccagctggagaagggggaccaactcagcgctgaggtcaatctgcccaagtacttagactttgcggagtccgggcaggtctactttggagtcattgctctgtga

SEQ ID NO: 76 - DNA, 702 bp, Homo sapiens
atgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtga

SEQ ID NO: 77 - DNA, 468 bp, Mus musculus
atgaacgctacacactgcatcttggctttgcagctcttcctcatggctgtttctggctgttactgccacggcacagtcattgaaagcctagaaagtctgaataactattttaactcaagtggcatagatgtggaagaaaagagtctcttcttggatatctggaggaactggcaaaaggatggtgacatgaaaatcctgcagagccagattatctctttctacctcagactctttgaagtcttgaaagacaatcaggccatcagcaacaacataagcgtcattgaatcacacctgattactaccttcttcagcaacagcaaggcgaaaaaggatgcattcatgagtattgccaagtttgaggtcaacaacccacaggtccagcgccaagcattcaatgagctcatccgagtggtccaccagctgttgccggaatccagcctcaggaagcggaaaaggagtcgctgctga

SEQ ID NO: 78 - DNA, 501 bp, Homo sapiens
atgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaa

SEQ ID NO: 79 - DNA, 2577 bp, Mus musculus
atggagcggccccggggagctgcggacggccttttgcgctggcccctcggcctcctcctgctccttcaactgctgcctcctgccgccgtcggccaggaccggctggacgcgccgccgccgcccgcgcctcctctgctgcgctgggccggtccggtcggggtgagctgggggctgcgcgccgccgcgcccgggggccccgtcccccgcgctggccgttggcgccgcggcgcgcccgccgaggaccaagactgcggccgcctcccggacttcatcgccaagctgaccaacaatacgcaccagcatgtctttgatgacctcagtggctcagtgtccttgtcctgggttggagacagcactggggttattctcgtcctgaccactttccaagtgcctctggtaattgtgagctttggacagtccaagttgtatcgaagtgaggattatggaaagaactttaaggatattacaaatctcatcaataacaccttcattcggacggaatttggcatggctattggtcctgagaactctggaaaggtgatactaacagcggaggtgtccgggggaagccgaggcggaagagtgttcaggtcatcagactttgccaagaactttgtgcaaacagatctcccctttcatcctctgacgcagatgatgtacagccctcagaattctgattacctgttagctctcagcaccgaaaatggcctgtgggtgtccaagaattttggggaaaaatgggaagaaatccacaaagcagtatgtttggccaaatggggaccaaacaacatcatcttctttaccacccatgtgaatggctcctgcaaagctgatcttggtgccctggaattatggagaacatccgacttgggaaaaaccttcaaaaccattggtgtgaaaatctactcctttggtcttgggggccgtttcctttttgcctctgtgatggctgataaggacacaacaagaaggatccatgtgtcaacagaccagggggacacatggagcatggcacaacttccttctgtgggacaggaacagttctactccatcctggcagccaatgaggacatggtcttcatgcatgtagatgaacctggagataccgggtttggcaccatctttacctctgatgatcgaggcattgtctactccaagtctctggacagacatctctataccaccacaggcggggagacggactttaccaacgtgacttccctccgtggggtctatataacaagcacgctctcagaagataactctattcagagcatgatcacttttgaccagggaggacggtgggagcacctgcggaagccggagaacagcaagtgcgacgctaccgcaaagaacaagaacgagtgcagccttcatatccatgcttcttatagcatctcccagaagctaaacgttccaatggccccactttccgagcccaatgctgtgggcatagtcatcgctcacggtagtgtgggagatgccatctcggtgatggtcccagatgtgtacatctcagatgatgggggttactcctgggcgaagatgctagaaggaccacattactataccatcctggactctggaggcatcattgtggccattgagcacagcaaccgtcctatcaatgtgattaagttctccacagatgaaggccagtgctggcagagctatgtgttcacacaggagcccatctacttcactgggcttgcttccgagcctggagccaggtccatgaacatcagcatctggggattcacagagtctttcattacccgccagtgggtctcctacacagtcgatttcaaagacatccttgagcggaattgtgaagaggatgactataccacgtggctggcacactccacagaccctggagattacaaagacggctgcattttgggctataaagaacagttcctacggctacggaagtcatccgtctgtcagaatggtcgagactatgttgtggccaagcagccatccgtctgtccgtgttccctggaggacttcctctgtgactttggctacttccgtccggagaacgcctcagagtgcgtggagcagcctgaactgaaggggcatgagttagagttctgtctgtacggcaaggaggagcacctgacaacaaatgggtaccggaaaatcccaggagacaaatgccaaggtgggatgaatcccgccagagaagtaaaagacttgaaaaagaaatgcacaagcaacttcttgaaccccacaaagcaggactcccgcccacagggacacagcttgtcccagaatccagctccgcctcctcttggatacactgaaaacacacacttcctatctcctacccagaagcagaattccaagtcaaattctgtccctattatcctggccatcgtgggactgatgcttgtcacagtcgtagcaggagtcctcattgtgaagaaatatgtctgtggcggaaggttcctggtgcaccggtactcggtgctacagcagcacgcagaggctgacggcgtagaggctttggattcaacctcccacgctaaaagcggatatcacgacgactcagatgaggacctcctggaatag

SEQ ID NO: 80 - DNA, 2496 bp, Homo sapiens
atggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatctttagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggatacaacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatag

SEQ ID NO: 81 - DNA, 531 bp, Mus musculus
ctggcgtctaacagagaagtgcggggccctgggcccgggactcccaggaaccggcccctgctgcccctgctgctgcttctgctcttgctaccgctgcccgccagcgcctggtataagcacgtggcgagtccccgctatcacacagtgggtcgtgcctccgggctgctcatggggctgcgccgctcgccctaccagtggcgccgtgccctgggcggggctgctggacccctctcccggctcccaggaccggtcgcccgcggcgctctcctgcttccttcctcagggcaggagctgtgggaggtacgaagcaggagctcacctgcagggcttcccgtccatgcaccctggagtccgcgggacctggagggagtccgccaaccggagcagtcgctaagccttcactcctggatctcagaggagcccgctgctagagccttcggagagacgcttcgtgcccagccatggttcctgcagcaagtcatctttgccgatcctgtcaggcccaagaaccgatggcgcccccatgcttga

SEQ ID NO: 82 - DNA, 498 bp, Homo sapiens
ctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgcgcgctgcgcgcggccgccgggcccctggccagggacaccctctcccccgaacccgcagcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccagagacttcggagagacgtctcccgcccagcggtggaccccgcagcaaaccgccttggcctgccctgcctggcccccggaccgttctga

SEQ ID NO: 83 - DNA, 351 bp, Mus musculus
atggagagctcccgcctgcggctgctacccctcctgggcgccgccctgctgctactgctacctttgctgggtgcccgtgcccaggaggacgccgagctgcagccccgagccctggacatctactctgccgtggatgatgcgtcccacgagaaggagctgatcgaagcgttgcaagaagtcctgaagaagctcaagagtaaacgcattccgatctacgagaagaagtacggccaagtccccatgtgtgacgctggagagcagtgcgcagtgaggaaaggggccaggatcgggaagctgtgtgactgtccccgaggaacttcctgcaattctttcctcttgaagtgcttgtga

SEQ ID NO: 84 - DNA, 351 bp, Homo sapiens
atggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctgatcgaagcgctgcaagaagtcttgaagaagctcaagagtaaacgtgttcccatctatgagaagaagtatggccaagtccccatgtgtgacgccggtgagcagtgtgcagtgaggaaaggggcaaggatcgggaagctgtgtgactgtccccgaggaacctcctgcaattccttcctcctgaagtgcttatga

SEQ ID NO: 85 - DNA, 1173 bp, Mus musculus
atgccgccctcggggctgcggctactgccgcttctgctcccactcccgtggcttctagtgctgacgcccgggaggccagccgcgggactctccacctgcaagaccatcgacatggagctggtgaaacggaagcgcatcgaagccatccgtggccagatcctgtccaaactaaggctcgccagtcccccaagccagggggaggtaccgcccggcccgctgcccgaggcggtgctcgctttgtacaacagcacccgcgaccgggtggcaggcgagagcgccgacccagagccggagcccgaagcggactactatgctaaagaggtcacccgcgtgctaatggtggaccgcaacaacgccatctatgagaaaaccaaagacatctcacacagtatatatatgttcttcaatacgtcagacattcgggaagcagtgcccgaacccccattgctgtcccgtgcagagctgcgcttgcagagattaaaatcaagtgtggagcaacatgtggaactctaccagaaatatagcaacaattcctggcgttaccttggtaaccggctgctgacccccactgatacgcctgagtggctgtcttttgacgtcactggagttgtacggcagtggctgaaccaaggagacggaatacagggctttcgattcagcgctcactgctcttgtgacagcaaagataacaaactccacgtggaaatcaacgggatcagccccaaacgtcggggcgacctgggcaccatccatgacatgaaccggcccttcctgctcctcatggccacccccctggaaagggcccagcacctgcacagctcacggcaccggagagccctggataccaactattgcttcagctccacagagaagaactgctgtgtgcggcagctgtacattgactttaggaaggacctgggttggaagtggatccacgagcccaagggctaccatgccaacttctgtctgggaccctgcccctatatttggagcctggacacacagtacagcaaggtccttgccctctacaaccaacacaacccgggcgcttcggcgtcaccgtgctgcgtgccgcaggctttggagccactgcccatcgtctactacgtgggtcgcaagcccaaggtggagcagttgtccaacatgattgtgcgctcctgcaagtgcagctga

SEQ ID NO: 86 - DNA, 1173 bp, Homo sapiens
atgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctga

SEQ ID NO: 87 - DNA, 1245 bp, Mus musculus
atgcactactgtgtgctgagcacctttttgctcctgcatctggtcccggtggcgctcagtctgtctacctgcagcaccctcgacatggatcagtttatgcgcaagaggatcgaggccatccgcgggcagatcctgagcaagctgaagctcaccagccccccggaagactatccggagccggatgaggtccccccggaggtgatttccatctacaacagtaccagggacttactgcaggagaaggcaagccggagggcagccgcctgcgagcgcgagcggagcgacgaggagtactacgccaaggaggtttataaaatcgacatgccgtcccacctcccctccgaaaatgccatcccgcccactttctacagaccctacttcagaatcgtccgctttgatgtctcaacaatggagaaaaatgcttcgaatctggtgaaggcagagttcagggtcttccgcttgcaaaaccccaaagccagagtggccgagcagcggattgaactgtatcagatccttaaatccaaagacttaacatctcccacccagcgctacatcgatagcaaggttgtgaaaaccagagcggagggtgaatggctctccttcgacgtgacagacgctgtgcaggagtggcttcaccacaaagacaggaacctggggtttaaaataagtttacactgcccctgctgtaccttcgtgccgtctaataattacatcatcccgaataaaagcgaagagctcgaggcgagatttgcaggtattgatggcacctctacatatgccagtggtgatcagaaaactataaagtccactaggaaaaaaaccagtgggaagaccccacatctcctgctaatgttgttgccctcctacagactggagtcacaacagtccagccggcggaagaagcgcgctttggatgctgcctactgctttagaaatgtgcaggataattgctgccttcgccctctttacattgattttaagagggatcttggatggaaatggatccatgaacccaaagggtacaatgctaacttctgtgctggggcatgcccatatctatggagttcagacactcaacacaccaaagtcctcagcctgtacaacaccataaatcccgaagcttccgcttccccttgctgtgtgtcccaggatctggaaccactgaccattctctattacattggaaatacgcccaagatcgaacagctttccaatatgattgtcaagtcttgtaaatgcagctaa

SEQ ID NO: 88 - DNA, 1329 bp, Homo sapiens
atgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaa

SEQ ID NO: 89 - DNA, 1239 bp, Mus musculus
atgaagatgcacttgcaaagggctctggtagtcctggccctgctgaacttggccacaatcagcctctctctgtccacttgcaccacgttggacttcggccacatcaagaagaagagggtggaagccattaggggacagatcttgagcaagctcaggctcaccagcccccctgagccatcggtgatgacccacgtcccctatcaggtcctggcactttacaacagcacccgggagttgctggaagagatgcacggggagagggaggaaggctgcactcaggagacctcggagtctgagtactatgccaaagagatccataaattcgacatgatccagggactggcggagcacaatgaactggccgtctgccccaaaggaattacctctaaggtttttcgtttcaatgtgtcctcagtggagaaaaatggaaccaatctgttccgggcagagttccgggtcttgcgggtgcccaaccccagctccaagcgcacagagcagagaattgagctcttccagatacttcgaccggatgagcacatagccaagcagcgctacataggtggcaagaatctgcccacaaggggcaccgctgaatggctgtctttcgatgtcactgacactgtgcgcgagtggctgttgaggagagagtccaacttgggtctggaaatcagcatccactgtccatgtcacacctttcagcccaatggagacatactggaaaatgttcatgaggtgatggaaatcaaattcaaaggagtggacaatgaagatgaccatggccgtggagacctggggcgtctcaagaagcaaaaggatcaccacaacccacacctgatcctcatgatgatccccccacaccgactggacagcccaggccagggcagtcagaggaagaagagggccctggacaccaattactgcttccgcaacctggaggagaactgctgtgtacgccccctttatattgacttccggcaggatctaggctggaaatgggtccacgaacctaagggttactatgccaacttctgctcaggcccttgcccatacctccgcagcgcagacacaacccatagcacggtgcttggactatacaacaccctgaacccagaggcgtctgcctcgccatgctgcgtcccccaggacctggagcccctgaccatcttgtactatgtgggcagaacccccaaggtggagcagctgtccaacatggtggtgaagtcgtgtaagtgcagctga

SEQ ID NO: 90 - DNA, 1239 bp, Homo sapiens
atgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctga

SEQ ID NO: 91 - DNA, 591 bp, Mus musculus
atgaggacctgggcttgcctgctgctcctcggctgcggatacctcgcccatgccctggccgaggaagccgagataccccgggagttgatcgagcggctggctcgaagtcagatccacagcatccgggacctccagcgactcttggagatagactccgtaggggctgaggatgccttggagacaagtctgagagcccatgggtcccatgccattaaccatgtgcccgagaagcggcctgtgcccattcgcaggaagagaagtattgaggaagccattcctgcagtttgcaagaccaggacggtcatttacgagatacctcggagccaggtggaccccacatcggccaacttcctgatctggcccccatgtgtggaggtgaagcgctgcactggctgttgtaacaccagcagcgtcaagtgccagccttcacgggtccaccaccgcagtgtcaaggtggccaaagtggagtatgtcaggaagaagccaaaattgaaagaggtccaggtgaggttagaggaacacctggagtgtgcatgtgcgacctccaacctgaacccagaccatcgggaggaggagacagatgtgaggtga

SEQ ID NO: 92 - DNA, 636 bp, Homo sapiens
atgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacgggaaggcctagggagtcaggtaaaaaacggaaaagaaaaaggttaaaacccacctaa

SEQ ID NO: 93 - DNA, 774 bp, Mus musculus
atgttccaccaggtgagaagagtgatgaccatccttttccttactatggttatttcatacttcggttgcatgaaggcggcgcccatgaaagaagtaaacgtccacggacaaggcaacttggcctacccaggtgtgcggacccatgggactctggagagcgtgaatgggcccagggcaggttcgagaggtctgacgacgacatcactggctgacacttttgagcacgtcatcgaagagctgctggatgaggaccagaaggttcggcccaacgaagaaaaccataaggacgcggacttgtacacttcccgggtgatgctcagcagtcaagtgcctttggagcctcctctactctttctgctggaggaatacaaaaattacctggatgccgcaaacatgtctatgagggttcggcgccactccgaccctgcccgccgtggggagctgagcgtgtgtgacagtattagcgagtgggtcacagcggcagataaaaagactgcagtggacatgtctggcgggacggtcacagtcctagagaaagtcccggtatccaaaggccaactgaagcagtatttctacgagaccaagtgtaatcccatgggttacaccaaggaaggctgcaggggcatagacaaaaggcactggaactcgcaatgccgaactacccaatcgtatgttcgggcccttactatggatagcaaaaagagaattggctggcgattcataaggatagacacttcctgtgtatgtacactgaccattaaaaggggaagatag

SEQ ID NO: 94 - DNA, 744 bp, Homo sapiens
atgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatag

SEQ ID NO: 95 - DNA, 726 bp, Mus musculus
atgtccatgttgttctacactctgatcactgcgtttttgatcggcgtacaggcagaaccgtacacagatagcaatgtcccagaaggagactctgtccctgaagcccactggactaaacttcagcattcccttgacacagccctccgcagagcccgcagtgcccctactgcaccaatagctgcccgagtgacagggcagacccgcaacatcactgtagaccccagactgtttaagaaacggagactccactcaccccgtgtgctgttcagcacccagcctccacccacctcttcagacactctggatctagacttccaggcccatggtacaatccctttcaacaggactcaccggagcaagcgctcatccacccacccagtcttccacatgggggagttctcagtgtgtgacagtgtcagtgtgtgggttggagataagaccacagccacagacatcaagggcaaggaggtgacagtgctggccgaggtgaacattaacaacagtgtattcagacagtacttttttgagaccaagtgccgagcctccaatcctgttgagagtgggtgccggggcatcgactccaaacactggaactcatactgcaccacgactcacaccttcgtcaaggcgttgacaacagatgagaagcaggctgcctggaggttcatccggatagacacagcctgtgtgtgtgtgctcagcaggaaggctacaagaagaggctga

SEQ ID NO: 96 - DNA, 726 bp, Homo sapiens
atgtccatgttgttctacactctgatcacagcttttctgatcggcatacaggcggaaccacactcagagagcaatgtccctgcaggacacaccatcccccaagcccactggactaaacttcagcattcccttgacactgcccttcgcagagcccgcagcgccccggcagcggcgatagctgcacgcgtggcggggcagacccgcaacattactgtggaccccaggctgtttaaaaagcggcgactccgttcaccccgtgtgctgtttagcacccagcctccccgtgaagctgcagacactcaggatctggacttcgaggtcggtggtgctgcccccttcaacaggactcacaggagcaagcggtcatcatcccatcccatcttccacaggggcgaattctcggtgtgtgacagtgtcagcgtgtgggttggggataagaccaccgccacagacatcaagggcaaggaggtgatggtgttgggagaggtgaacattaacaacagtgtattcaaacagtacttttttgagaccaagtgccgggacccaaatcccgttgacagcgggtgccggggcattgactcaaagcactggaactcatattgtaccacgactcacacctttgtcaaggcgctgaccatggatggcaagcaggctgcctggcggtttatccggatagatacggcctgtgtgtgtgtgctcagcaggaaggctgtgagaagagcctga

SEQ ID NO: 97 - DNA, 1827 bp, Mus musculus
atgaagtgggtaacctttctcctcctcctcttcgtctccggctctgctttttccaggggtgtgtttcgccgagaagcacacaagagtgagatcgcccatcggtataatgatttgggagaacaacatttcaaaggcctagtcctgattgccttttcccagtatctccagaaatgctcatacgatgagcatgccaaattagtgcaggaagtaacagactttgcaaagacgtgtgttgccgatgagtctgccgccaactgtgacaaatcccttcacactctttttggagataagttgtgtgccattccaaacctccgtgaaaactatggtgaactggctgactgctgtacaaaacaagagcccgaaagaaacgaatgtttcctgcaacacaaagatgacaaccccagcctgccaccatttgaaaggccagaggctgaggccatgtgcacctcctttaaggaaaacccaaccacctttatgggacactatttgcatgaagttgccagaagacatccttatttctatgccccagaacttctttactatgctgagcagtacaatgagattctgacccagtgttgtgcagaggctgacaaggaaagctgcctgaccccgaagcttgatggtgtgaaggagaaagcattggtctcatctgtccgtcagagaatgaagtgctccagtatgcagaagtttggagagagagcttttaaagcatgggcagtagctcgtctgagccagacattccccaatgctgactttgcagaaatcaccaaattggcaacagacctgaccaaagtcaacaaggagtgctgccatggtgacctgctggaatgcgcagatgacagggcggaacttgccaagtacatgtgtgaaaaccaggcgactatctccagcaaactgcagacttgctgcgataaaccactgttgaagaaagcccactgtcttagtgaggtggagcatgacaccatgcctgctgatctgcctgccattgctgctgattttgttgaggaccaggaagtgtgcaagaactatgctgaggccaaggatgtcttcctgggcacgttcttgtatgaatattcaagaagacaccctgattactctgtatccctgttgctgagacttgctaagaaatatgaagccactctggaaaagtgctgcgctgaagccaatcctcccgcatgctacggcacagtgcttgctgaatttcagcctcttgtagaagagcctaagaacttggtcaaaaccaactgtgatctttacgagaagcttggagaatatggattccaaaatgccattctagttcgctacacccagaaagcacctcaggtgtcaaccccaactctcgtggaggctgcaagaaacctaggaagagtgggcaccaagtgttgtacacttcctgaagatcagagactgccttgtgtggaagactatctgtctgcaatcctgaaccgtgtgtgtctgctgcatgagaagaccccagtgagtgagcatgttaccaagtgctgtagtggatccctggtggaaaggcggccatgcttctctgctctgacagttgatgaaacatatgtccccaaagagtttaaagctgagaccttcaccttccactctgatatctgcacacttccagagaaggagaagcagattaagaaacaaacggctcttgctgagctggtgaagcacaagcccaaggctacagcggagcaactgaagactgtcatggatgactttgcacagttcctggatacatgttgcaaggctgctgacaaggacacctgcttctcgactgagggtccaaaccttgtcactagatgcaaagacgccttagcctaa

SEQ ID NO: 98 - DNA, 1830 bp, Homo sapiens
atgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataa

SEQ ID NO: 99 - DNA, 411 bp, Mus musculus
atgggcttcctgaagttctcccctttcctggttgtcagcatcttgctcctgtaccaggcatgcagcctccaggcagtgcctttgaggtcaatcttggaaagcagcccaggcatggccactctcagtgaagaagaagttcgcctgctggctgcactggtgcaggactatatgcagatgaaagccagggagctggagcaggaggaagagcaggaggctgagggctctagcttggacagccccagatctaagcggtgtgggaatctgagtacctgcatgctgggcacgtacacacaagacctcaacaagtttcacaccttcccccaaacttcaattggggttgaagcacctggcaagaaaagggatgtggccaaggacttggagacaaaccaccaatcccattttggcaactaa

SEQ ID NO: 100 - DNA, 426 bp, Homo sapiens
atgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaa

SEQ ID NO: 101 - DNA, 6 bp, Artificial Sequence
  Protease cleavage sites
aagagg

SEQ ID NO: 102 - DNA, 6 bp, Artificial Sequence
  Protease cleavage site
aagcgt

SEQ ID NO: 103 - DNA, 6 bp, Artificial Sequence
  Protease cleavage site
aagcgc

SEQ ID NO: 104 - DNA, 6 bp, Artificial Sequence
  Protease cleavage site
aaaaga

SEQ ID NO: 105 - DNA, 9 bp, Artificial Sequence
  Protease cleavage site
aagaggagg

SEQ ID NO: 106 - DNA, 6 bp, Artificial Sequence
  Protease cleavage site
aagaga

SEQ ID NO: 107 - DNA, 6 bp, Artificial Sequence
  Protease cleavage site
cgcaaa

SEQ ID NO: 108 - DNA, 6 bp, Artificial Sequence
  Protease cleavage site
cggcgg

SEQ ID NO: 109 - DNA, 6 bp, Artificial Sequence
  Protease cleavage site
tatctg

SEQ ID NO: 110 - DNA, 6 bp, Artificial Sequence
  Protease cleavage site
aggcgg

SEQ ID NO: 111 - DNA, 6 bp, Artificial Sequence
  Protease cleavage site
cggagc

SEQ ID NO: 112 - DNA, 6 bp, Artificial Sequence
  Protease cleavage site
cggtct

SEQ ID NO: 113 - DNA, 6 bp, Artificial Sequence
  Protease cleavage site
cgaagc

SEQ ID NO: 114 - DNA, 6 bp, Artificial Sequence
  Protease cleavage site
aaacgg

SEQ ID NO: 115 - DNA, 9 bp, Artificial Sequence
  Protease cleavage site
aagagaggt

SEQ ID NO: 116 - DNA, 9 bp, Artificial Sequence
  Protease cleavage site
aaacgaggc

SEQ ID NO: 117 - DNA, 10 bp, Artificial Sequence
  Protease cleavage site
gggccgccgc

SEQ ID NO: 118 - DNA, 9 bp, Artificial Sequence
  Protease cleavage site
ccacgagct

SEQ ID NO: 119 - DNA, 9 bp, Artificial Sequence
  Protease cleavage site
ccccgagct

SEQ ID NO: 120 - DNA, 18 bp, Artificial Sequence
  Protease cleavage site
cgaaggcagctgcgggct

SEQ ID NO: 121 - DNA, 18 bp, Artificial Sequence
  Protease cleavage site
cgtaggcagctgagggta

SEQ ID NO: 122 - DNA, 9 bp, Artificial Sequence
  Protease cleavage site
cgccgcagt

SEQ ID NO: 123 - DNA, 6 bp, Artificial Sequence
  Protease cleavage site
cgaaga

SEQ ID NO: 124 - DNA, 6 bp, Artificial Sequence
  Protease cleavage site
cggaga

SEQ ID NO: 125 - DNA, 6 bp, Artificial Sequence
  Protease cleavage site
agaagg

SEQ ID NO: 126 - DNA, 6 bp, Artificial Sequence
  Protease cleavage site
aaacgc

SEQ ID NO: 127 - DNA, 15 bp, Artificial Sequence
  Protease cleavage site
tccagcattcggagg

SEQ ID NO: 128 - DNA, 12 bp, Artificial Sequence
  Protease cleavage site
agcagtcggagg

SEQ ID NO: 129 - DNA, 9 bp, Artificial Sequence
  Protease cleavage site
gagagggac

SEQ ID NO: 130 - DNA, 6 bp, Artificial Sequence
  Protease cleavage site
cggcgc

SEQ ID NO: 131 - DNA, 6 bp, Artificial Sequence
  Protease cleavage site
aggcgc

SEQ ID NO: 132 - DNA, 12 bp, Artificial Sequence
  Protease cleavage site
cggggcaccaag

SEQ ID NO: 133 - DNA, 6 bp, Artificial Sequence
  Protease cleavage site
caccgc

SEQ ID NO: 134 - DNA, 9 bp, Artificial Sequence
  Protease cleavage site
acccgtgtc

SEQ ID NO: 135 - DNA, 9 bp, Artificial Sequence
  Protease cleavage site
tcgcgcatt

SEQ ID NO: 136 - DNA, 6 bp, Artificial Sequence
  Protease cleavage site
cgacgg

SEQ ID NO: 137 - DNA, 9 bp, Artificial Sequence
  Protease cleavage site
aagagaaga

SEQ ID NO: 138 - DNA, 9 bp, Artificial Sequence
  Protease cleavage site
ggccgccgc

SEQ ID NO: 139 - DNA, 798 bp, Artificial Sequence
  Luciferase fusion protein
atgatgtgcatctccaaactgccagctgtcctcctcatcctctctgtggcactgaaccacttgagagctacacctgtcagaagtggtagcaaccctcagatggacaaacggaagtgcaacacggccacgtgtgccacacaacgcctggcaaactttttggttcgttccagcaacaaccttggtccagtcctcccaccaaccaacgtgggatcgaatacatatggcaagaggaatgcgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagaggaatgcggcaggggatccaaatagggaatccttggatttcttactcgtttaa

SEQ ID NO: 140 - DNA, 786 bp, Artificial Sequence
  Luciferase fusion protein
atgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagaggaatgcggtagaggttttaaagagagagccactgaattacttgcccctttag

SEQ ID NO: 141 - DNA, 843 bp, Artificial Sequence
  Luciferase fusion protein
atggccctgtggatgcgcttcctgcccctgctggccctgctcttcctctgggagtcccaccccacccaggcttttgtcaagcagcacctttgtggttcccacctggtggaggctctctacctggtgtgtggggagcgtggcttcttctacacacccatgtcccgccgtgaagtggaggacccacaagtggcacaactggagctgggtggaggcccgggagcaggtgaccttcagaccttggcactggaggtggcccagcagaagaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgtggcattgtagatcagtgctgcaccagcatctgctccctctaccagctggagaactactgcaactag

SEQ ID NO: 142 - DNA, 843 bp, Artificial Sequence
  Luciferase fusion protein
atggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgtggcattgtggaacaatgctgtaccagcatctgctccctctaccagctggagaactactgcaactag

SEQ ID NO: 143 - DNA, 1068 bp, Artificial Sequence
  Luciferase fusion protein
atgaagaccatttactttgtggctggattgcttataatgctggtgcaaggcagctggcagcacgcccttcaagacacagaggagaaccccagatcattcccagcttcccagacagaagcgcatgaggaccctgatgagatgaatgaagacaaacgccactcacagggcacattcaccagcgactacagcaaatacctggactcccgccgtgcccaagattttgtgcagtggttgatgaacaccaagaggaaccggaacaacattgccaaacgtcatgatgaatttgagaggcatgctgaagggacctttaccagtgatgtgagttcttacttggagggccaggcagcaaaggaattcattgcttggctggtgaaaggccgaggaaggcgagacttcccagaagaagtcgccattgccgaggaactcggccgaaagagaagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgcggccgcaggcacgctgatggctccttctctgacgagatgagcaccattctggataatcttgccaccagggacttcatcaactggctgattcaaaccaagatcactgacaagaaatag

SEQ ID NO: 144 - DNA, 1068 bp, Artificial Sequence
  Luciferase fusion protein
atgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgaaagagaagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgcggccgcagacatgctgatggttctttctctgatgagatgaacaccattcttgataatcttgccgccagggactttataaactggttgattcagaccaaaatcactgacaggaaataa

SEQ ID NO: 145 - DNA, 810 bp, Artificial Sequence
  luciferase fusion protein
atggtggcggtgcgcaggccttggcccgtcacggtcgcaatgctgctaatcctgctcgcctgtctgggagccctggtggacgcctaccctgccaaaccagaggctcccggcgaagacgcctccccggaggagctgagccgctactacgcctccctgcgccactacctcaacctggtcacccggcagcggtatggaaaaagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagaggagggatgtccccgcagctctgttctccaaactgctcttcacagacgacagcgacagcgagaacctccccttcaggccagaaggtttggaccagtggtga

SEQ ID NO: 146 - DNA, 807 bp, Artificial Sequence
  Luciferase fusion protein
atggtgttcgtgcgcaggccgtggcccgccttgaccacagtgcttctggccctgctcgtctgcctaggggcgctggtcgacgcctaccccatcaaacccgaggctcccggcgaagacgcctcgccggaggagctgaaccgctactacgcctccctgcgccactacctcaacctggtcacccggcagcggtatgggaaaagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagaggagggacggcccggacacgcttctttccaaaacgttcttccccgacggcgaggaccgccccgtcaggtcgcggtcggagggcccagacctgtggtga

SEQ ID NO: 147 - DNA, 807 bp, Artificial Sequence
  Luciferase fusion protein
atgctaggtaacaagcgaatggggctgtgtggactgaccctcgctctatctctgctcgtgtgtttgggcattctggctgaggggtacccctccaagccggacaatccgggcgaggacgcgccagcagaggacatggccagatactactccgctctgcgacactacatcaatctcatcaccagacagagatatggcaagagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagaggaggtccagccctgagacactgatttcagacctcttaatgaaggaaagcacagaaaacgcccccagaacaaggcttgaagacccttccatgtggtga

SEQ ID NO: 148 - DNA, 807 bp, Artificial Sequence
  Luciferase fusion protein
atgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagaggaggtccagcccagagacactgatttcagacctcttgatgagagaaagcacagaaaatgttcccagaactcggcttgaagaccctgcaatgtggtga

SEQ ID NO: 149 - DNA, 816 bp, Artificial Sequence
  Luciferase fusion protein
atggccgtcgcatactgctgcctctccctgtttctcgtatccacttgggtggctctgctgctgcagcccctgcaggggacctggggagcccccctggagccaatgtacccaggcgactatgcgacacctgagcagatggcacaatatgaaactcagctccgcagatacatcaacacactgaccaggcctaggtatgggaagagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagaggagggccgaggaggagaacacaggtggacttcctggagtgcagctctccccctgcaccagccccccagttggcttgattccctgctctgcgccctggagctga

SEQ ID NO: 150 - DNA, 801 bp, Artificial Sequence
  Luciferase fusion protein
atggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtatgggaaaagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagaggaggcacaaagaggacacgctggccttctcggagtgggggtccccgcatgctgctgtccccagggagctcagcccgctggacttataa

SEQ ID NO: 151 - DNA, 867 bp, Artificial Sequence
  Luciferase fusion protein
atgctgtcctgccgtctccagtgcgccctggctgcgctctgcatcgtcctggctttgggcggtgtcaccggcgcgccctcggaccccagactccgtcagtttctgcagaagtctctggcggctgccaccgggaaacaggaactggccaagtacttcttggcagagctgcgcaaaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgcaaactgtccgagcccaaccagacagagaatgatgccctggagcccgaggatttgccccaggcagctgagcaggacgagatgaggctggagctgcagaggtctgccaactcgaacccagcaatggcaccccgggaacgcaaagctggctgcaagaacttcttctggaagacattcacatcctgttag

SEQ ID NO: 152 - DNA, 867 bp, Artificial Sequence
  Luciferase fusion protein
atgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgcgcaaaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgcaaactgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttag

SEQ ID NO: 153 - DNA, 828 bp, Artificial Sequence
  Luciferase fusion protein
atgctgctctgggtgctctttgtgatcctcatcctcaccagtggctcccactgctcactgcccccctcacctcccttcaggatgcagcgacacgtagatgccatcttcaccaccaactacaggaaactcctgagccagctgtatgcccggaaagtgatccaggacatcatgaacaagcaaggggagaggatccaggaacaaagggccaggctcagccgccaggaagacagcatgtggacagaggacaagcagatgaccctggagagcatccggcggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggcggttgcagggattcccaaggatgaagccttcagcggacgcttga

SEQ ID NO: 154 - DNA, 840 bp, Artificial Sequence
  Luciferase fusion protein
atgccactctgggtgttcttctttgtgatcctcaccctcagcaacagctcccactgctccccacctccccctttgaccctcaggatgcggcggtatgcagatgccatcttcaccaacagctaccggaaggtgctgggccagctgtccgcccgcaagctgctccaggacatcatgagcaggcagcagggagagagcaaccaagagcgaggagcaagggcacggcttggtcgtcaggtagacagcatgtgggcagaacaaaagcaaatggaattggagagcatcctggtggccctgcggcggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggcggctgcagaagcacaggaactcccagggatga

SEQ ID NO: 155 - DNA, 1218 bp, Artificial Sequence
  Luciferase fusion protein
atgccgagattctgctacagtcgctcaggggccctgttgctggccctcctgcttcagacctccatagatgtgtggagctggtgcctggagagcagccagtgccaggacctcaccacggagagcaacctgctggcttgcatccgggcttgcaaactcgacctctcgctggagacgcccgtgtttcctggcaacggagatgaacagcccctgactgaaaacccccggaagtacgtcatgggtcacttccgctgggaccgcttcggccccaggaacagcagcagtgctggcagcgcggcgcagaggcgtgcggaggaagaggcggtgtggggagatggcagtccagagccgagtccacgcgagggcaagcgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgctcctactccatggagcacttccgctggggcaagccggtgggcaagaaacggcgcccggtgaaggtgtaccccaacgttgctgagaacgagtcggcggaggcctttcccctagagttcaagagggagctggaaggcgagcggccattaggcttggagcaggtcctggagtccgacgcggagaaggacgacgggccctaccgggtggagcacttccgctggagcaacccgcccaaggacaagcgttacggtggcttcatgacctccgagaagagccagacgcccctggtgacgctcttcaagaacgccatcatcaagaacgcgcacaagaagggccagtga

SEQ ID NO: 156 - DNA, 1314 bp, Artificial Sequence
  Luciferase fusion protein
atgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtga

SEQ ID NO: 157 - DNA, 888 bp, Artificial Sequence
  Luciferase fusion protein
atggcctgccccagtctcgcttgctgcctgcttggcttactggctctgacctcggcctgctacatccagaactgccccctgggcggcaagaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgcgctgtgctggacctggatatgcgcaagtgtctcccctgcggcccgggcggcaaaggacgctgcttcggaccaagcatctgctgcgcggacgagctgggctgcttcgtgggcaccgccgaggcgctgcgctgccaggaggagaactacctgccttcgccctgccagtctggccagaagccctgcgggagcggaggccgctgcgccgccacaggcatctgctgcagcccggatggctgccgcacagaccccgcctgcgaccctgagtctgccttctcggagcgctga

SEQ ID NO: 158 - DNA, 888 bp, Artificial Sequence
  Luciferase fusion protein
atggccggccccagcctcgcttgctgtctgctcggcctcctggcgctgacctccgcctgctacatccagaactgccccctgggaggcaagaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgcgccgcgccggacctcgacgtgcgcaagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccggacggctgccacgccgaccctgcctgcgacgcggaagccaccttctcccagcgctga

SEQ ID NO: 159 - DNA, 1017 bp, Artificial Sequence
  Luciferase fusion protein
atgctcgccaggatgctcaacactacgctctccgcttgtttcctgagcctgctggccttctcctccgcctgctacttccagaactgcccaagaggcggcaagaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgcgccatctctgacatggagctgagacagtgtctcccctgcggcccgggcggcaaaggacgctgcttcggaccaagcatctgctgcgcggacgagctgggctgcttcgtgggcaccgccgaggcgctgcgctgccaggaggagaactacctgccctcgccctgccagtccggccagaagccctgcgggagcgggggccgctgcgccgccgtgggcatctgctgcagcgacgagagctgcgtggccgagcccgagtgccacgacggttttttccgcctcacccgcgctcgggagccaagcaacgccacacagctggacggccctgctcgggcgctgctgctaaggctggtacagctggctgggacacgggagtccgtggattctgccaagccccgggtctactga

SEQ ID NO: 160 - DNA, 1005 bp, Artificial Sequence
  Luciferase fusion protein
atgcctgacaccatgctgcccgcctgcttcctcggcctactggccttctcctccgcgtgctacttccagaactgcccgaggggcggcaagaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgcgccatgtccgacctggagctgagacagtgcctcccctgcggccccgggggcaaaggccgctgcttcgggcccagcatctgctgcgcggacgagctgggctgcttcgtgggcacggctgaggcgctgcgctgccaggaggagaactacctgccgtcgccctgccagtccggccagaaggcgtgcgggagcgggggccgctgcgccgccttcggcgtttgctgcaacgacgagagctgcgtgaccgagcccgagtgccgcgagggctttcaccgccgcgcccgcgccagcgaccggagcaacgccacgcagctggacgggccggccggggccttgctgctgcggctggtgcagctggccggggcgcccgagcccttcgagcccgcccagcccgacgcctactga

SEQ ID NO: 161 - DNA, 783 bp, Artificial Sequence
  Luciferase fusion protein
atgatcctcaaactgatggccggcattctactgctgactgtgtgtttggaaggctgctccagccagcactggtcctatgggttgcgccctgggggaaagagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgcaacactgaacacttggttgagtctttccaagagatgggcaaggaggtggatcaaatggcagaaccccagcacttcgaatgtactgtccactggccccgttcacccctcagggatctgcgaggagctctggaaagtctgattgaagaggaagccaggcagaagaagatgtag

SEQ ID NO: 162 - DNA, 789 bp, Artificial Sequence
  Luciferase fusion protein
atgaagccaattcaaaaactcctagctggccttattctactgacttggtgcgtggaaggctgctccagccagcactggtcctatggactgcgccctggaggaaagagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgcgatgccgaaaatttgattgattctttccaagagatagtcaaagaggttggtcaactggcagaaacccaacgcttcgaatgcaccacgcaccagccacgttctcccctccgagacctgaaaggagctctggaaagtctgattgaagaggaaactgggcagaagaagatttaa

SEQ ID NO: 163 - DNA, 927 bp, Artificial Sequence
  Luciferase fusion protein
atgagtgctgccgtcctcctctccgtgctttttgctcttgcttgtgggcaagcagcatccttttgtattcccactgagtatacaatgtacgtggataggagagagtgtgcctactgcctgaccatcaacaccaccatctgtgctgggtattgtatgacacgggatatcaatggcaaactgtttcttcccaaatatgcactctctcaggatgtctgtacatacagagacttcatctacagaacggtggaaataccaggatgcccgcaccatgttactccttatttctccttccctgtcgccataagctgcaagtgtggcaagtgtaatactgacaacagtgactgcatacacgaggctgtcagaaccaactactgcaccaagccgcagtctttctatctgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactatctggggggattttctgtttaa

SEQ ID NO: 164 - DNA, 927 bp, Artificial Sequence
  Luciferase fusion protein
atgactgctctctttctgatgtccatgctttttggccttacatgtgggcaagcgatgtctttttgtattccaactgagtatacaatgcacatcgaaaggagagagtgtgcttattgcctaaccatcaacaccaccatctgtgctggatattgtatgacacgggatatcaatggcaaactgtttcttcccaaatatgctctgtcccaggatgtttgcacatatagagacttcatctacaggactgtagaaataccaggatgcccactccatgttgctccctatttttcctatcctgttgctttaagctgtaagtgtggcaagtgcaatactgactatagtgactgcatacatgaagccatcaagacaaactactgtaccaaacctcagaagtcttatctgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactatctggtaggattttctgtctaa

SEQ ID NO: 165 - DNA, 1074 bp, Artificial Sequence
  Luciferase fusion protein
atgcggctgcggctgctggtgtccgcgggcatgctgctggtggctctgtcgtcctgcctgccttgcagggccctgctcagcaggggatccgtcccccgagcgccgcgggccccgcagcccttgaatttcttgcagccggagcagccccagcaacctcagccggttctgatccgcatgggtgaagaatacttcctccgcctggggaatctcaacagaagtcccgctgctcggctgtcccccaactccacgcccctcaccgcgggtcgcggcagccgcccctcgcacgaccaggctgcggctaactttttccgcgtgttgctgcagcagctgcagatgcctcagcgctcgctcgacagccgcgcggagccggccgaacgcggcgccgaggatgccctcggtggccaccagggggcgctggagagggagaggcggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaggcggtcggaggagccgcccatctctctggatctcaccttccaccttctgcgggaagtcttggaaatggcccgggcagagcagttagctcagcaagctcacagcaacaggaaactgatggagattatcgggaaatga

SEQ ID NO: 166 - DNA, 1101 bp, Artificial Sequence
  Luciferase fusion protein
atgcggctgccgctgcttgtgtccgcgggagtcctgctggtggctctcctgccctgcccgccatgcagggcgctcctgagccgcgggccggtcccgggagctcggcaggcgccgcagcaccctcagcccttggatttcttccagccgccgccgcagtccgagcagccccagcagccgcaggctcggccggtcctgctccgcatgggagaggagtacttcctccgcctggggaacctcaacaagagcccggccgctcccctttcgcccgcctcctcgctcctcgccggaggcagcggcagccgcccttcgccggaacaggcgaccgccaactttttccgcgtgttgctgcagcagctgctgctgcctcggcgctcgctcgacagccccgcggctctcgcggagcgcggcgctaggaatgccctcggcggccaccaggaggcaccggagagagaaaggcggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaggcggtccgaggagcctcccatctccctggatctcaccttccacctcctccgggaagtcttggaaatggccagggccgagcagttagcacagcaagctcacagcaacaggaaactcatggagattattgggaaataa

SEQ ID NO: 167 - DNA, 969 bp, Artificial Sequence
  Luciferase fusion protein
atgggctccttctccatcaccctgggcttcttcctcgtcttggccttttggcttccaggccatattggagcaaatcctgtgtacagtgcggtgtccaacacagatctgatggatttcaagaacctgctagaccacctggaggagaagatgccggtagaagatgaggtcatgcccccgcaggccctgagtgagcagactgaggaagcaggggccgcacttagctccctccccgaggtgcctccctggactggggaggtcaacccacctctgagagacggcagtgctctagggcgcagcccctgggacccctccgatagatctgccctcttgaaaagcaaactgagggctctgctcgctggccctcggagcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggagcctacgaagatccagctgcttcgggggtaggattgacaggattggagcccagagtggactaggctgcaacagcttccggtaccgaagataa

SEQ ID NO: 168 - DNA, 966 bp, Artificial Sequence
  Luciferase fusion protein
atgagctccttctccaccaccaccgtgagcttcctccttttactggcattccagctcctaggtcagaccagagctaatcccatgtacaatgccgtgtccaacgcagacctgatggatttcaagaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggagcctgcggagatccagctgcttcgggggcaggatggacaggattggagcccagagcggactgggctgtaacagcttccggtactga

SEQ ID NO: 169 - DNA, 876 bp, Artificial Sequence
  Luciferase fusion protein
atggatctcctgaaggtgctgtcccagatgattctgtttctgcttttcctttatctgtcaccgctgggaggtcactcctatcctctgggaagtcctagccagtctccagagcaattcaagatgcagaagctgctggagctgataagagaaaagtcggaggaaatggcccagagacagctcttgaaggaccaaggcctcacaaaagaacacccaaaaagagtccttcggtctaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggtctcaaggcagcaccctccgggtccagcagagacctcaaaattccaaggtgacacatatctcaagctgctttgggcacaagatagaccggatcggatccgtcagtcgtttgggctgtaacgcactgaagttgttgtag

SEQ ID NO: 170 - DNA, 921 bp, Artificial Sequence
  Luciferase fusion protein
atggatccccagacagcaccttcccgggcgctcctgctcctgctcttcttgcatctggctttcctgggaggtcgttcccacccgctgggcagccccggttcagcctcggacttggaaacgtccgggttacaggagcagcgcaaccatttgcagggcaaactgtcggagctgcaggtggagcagacatccctggagcccctccaggagagcccccgtcccacaggtgtctggaagtcccgggaggtagccaccgagggcatccgtgggcaccgcaaaatggtcctctacaccctgcgggcaccacgaagcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgaagccgaagccccaagatggtgcaagggtctggctgctttgggaggaagatggaccggatcagctcctccagtggcctgggctgcaaagtgctgaggcggcattaa

SEQ ID NO: 171 - DNA, 1719 bp, Artificial Sequence
  Luciferase fusion protein
atggacagaaggaggatgcctctctgggcactcttgttgctctggagtccttgcaccttcagtctcccaacacgcaccgctacctttgaacgaatcccgctcaagaaaatgccttctgtccgggaaatcctggaggagcggggagtggacatgaccaggctcagtgctgaatggggcgtattcacaaagaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagaggccttccttgaccaatcttacctcccccgtggtcctcaccaactacctgaatacccagtactacggcgagattggcatcggtaccccaccccagaccttcaaagtcatctttgacacgggttcagccaacctctgggtgccctccaccaagtgcagccgcctctaccttgcttgtgggattcacagcctctatgagtcctctgactcctccagctacatggagaacgggtccgacttcaccatccactacggatcagggagagtcaaaggtttcctcagccaggactcggtgactgtgggtggaatcactgtgacacagacctttggagaggtcaccgagctgcccctgatccctttcatgctggccaagtttgacggtgttctaggcatgggctttcccgctcaggccgttggcggggttacccctgtctttgaccacattctctcccagggggtgctaaaggaggaagtgttctctgtctactacaacaggggttcccacctgctggggggcgaggtggtgctaggaggtagcgacccgcagcattatcaaggcaattttcactatgtgagcatcagcaagactgactcctggcagatcacgatgaagggggtgtctgtggggtcttccaccctgctatgtgaagaaggctgtgcggtagtggtggacactggttcatcctttatctcggctcctacgagctccctgaagttgatcatgcaagccctgggagccaaggagaagagaatagaagaatatgttgtgaactgtagccaggtgcccaccctccccgacatttcctttgacctgggaggcagggcctacacactcagcagtacggactacgtgctacagtatcccaacaggagagacaagctgtgcacactggctctccatgccatggacatcccaccacccactgggcctgtctgggtcctgggtgccaccttcatccgcaagttctatacagagtttgatcggcataacaatcgcattggattcgccttggcccgctaa

SEQ ID NO: 172 - DNA, 1731 bp, Artificial Sequence
  Luciferase fusion protein
atggatggatggagaaggatgcctcgctggggactgctgctgctgctctggggctcctgtacctttggtctcccgacagacaccaccacctttaaacggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaaacggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattggcatcggcaccccaccccagaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacagagattccgagaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctga

SEQ ID NO: 173 - DNA, 888 bp, Artificial Sequence
  Luciferase fusion protein
atggccagaggcagcgttatcctgctaggctggctcctgttggttgtgaccctgtcagccactctgggacttgggatgcctgcaaaggagaagagaggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagagaggttggaccctgaacagcgctggctaccttctgggcccacatgccattgacaaccacagatcatttagcgacaagcatggcctcacaggcaagagggagttacaactggaggtggaggaaaggagaccaggaagtgttgatgtgcccctgcctgagagcaacattgtccgcactataatggagtttctcagtttcttgcaccttaaagaggccggggccctcgacagcctgcctggcatccccttggccacctcctcagaagacctagagaagtcctga

SEQ ID NO: 174 - DNA, 885 bp, Artificial Sequence
  luciferase fusion protein
atggcccgaggcagcgccctcctgctcgcctccctcctcctcgccgcggccctttctgcctctgcggggctctggtcgccggccaaggaaaaacgaggcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctga

SEQ ID NO: 175 - DNA, 906 bp, Artificial Sequence
  luciferase fusion protein
atgaactttccttctacaaaggttccctgggccgccgtgacgctgctgctgctgctactgctgccgccggcgctgctgtcgcttggggtggacgcacagcctctgcccgactgctgtcgccagaagacgtgttcctgccgtctctacgaactgttgcacggagctggcaaccacgctgcgggtatcctgactctgggaaagcggcggcctggacctccaggcctccagggacggctgcagcgcctccttcaggccaacggtaaccacgcagctggcatcctgaccatgggccgccgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacggccgccgcgcaggcgcagagctagagccacatccctgctctggtcgcggctgtccgaccgtaactaccaccgctttagcaccccggggagggtccggagtctga

SEQ ID NO: 176 - DNA, 909 bp, Artificial Sequence
  luciferase fusion protein
atgaaccttccttccacaaaggtctcctgggccgccgtgacgctactgctgctgctgctgctgctgccgcccgcgctgttgtcgtccggggcggctgcacagcccctgcccgactgctgtcgtcaaaagacttgctcttgccgcctctacgagctgctgcacggcgcgggcaatcacgcggccggcatcctcacgctgggcaagcggaggtccgggcccccgggcctccagggtcggctgcagcgcctcctgcaggccagcggcaaccacgccgcgggcatcctgaccatgggccgccgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacggccgccgcgcaggcgcagagccagcgccgcgcccctgcctcgggcgccgctgttccgccccggccgccgcctccgtcgcgcccggaggacagtccgggatctga

SEQ ID NO: 177 - DNA, 867 bp, Artificial Sequence
  luciferase fusion protein
atgctgtcttcaggcaccatctgcagtttgctgctactcagcatgctctggatggacatggccatggcaggctccagcttcctgagcccagagcaccagaaagcccagcagagaaaggaatccaagaagccaccagctaaactgcagccacgagctaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacccacgagctctggaaggctggctccacccagaggacagaggacaagcagaagagacagaggaggagctggagatcaggttcaatgctcccttcgatgttggcatcaagctgtcaggagctcagtatcagcagcatggccgggccctggggaagtttcttcaggatatcctctgggaagaggtcaaagaggcgccagctgacaagtaa

SEQ ID NO: 178 - DNA, 864 bp, Artificial Sequence
  luciferase fusion protein
atgccctccccagggaccgtctgcagcctcctgctcctcggcatgctctggctggacttggccatggcaggctccagcttcctgagccctgaacaccagagagtccagagaaaggagtcgaagaagccaccagccaagctgcagccccgagctaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtga

SEQ ID NO: 179 - DNA, 870 bp, Artificial Sequence
  luciferase fusion protein
atgaagagcggcgtatgtctgtgcgtggtgatggcagtcctagctgctggcgccctggcgcagccggtagtccctgcagaagctacggaccccgtggagcagcgggcgcaagaggcgccccgaaggcagctgcgggctaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgaaggcagctgcgggctgtgctccggacggacggcgagccccgagcgcgcctgggcgcactgctagcgcgatacatccagcaggtccgcaaagctccttctggccgcatgtccgttcttaagaacctgcagagcctggaccccagccatagaataagtgaccgggactacatgggctggatggattttggccggcgcagtgccgaggactacgaatacccatcgtag

SEQ ID NO: 180 - DNA, 870 bp, Artificial Sequence
  luciferase fusion protein
atgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctag

SEQ ID NO: 181 - DNA, 819 bp, Artificial Sequence
  luciferase fusion protein
atgcctcgactgtgtgtgtacatgctggtcttagtgctggctctagctaccttctcggaagcttcttggaagccccgctcccagctacaggatgcatcatctggaccagggaccaatgaggacctggaacagcgccagttcaacaagctgggctcagcctctcaccatcgaaggcagctggggccccagggtcctcaacacttcatagcagacctgtccaagaagcagaggccacgaatggaggaagaagaagaggcctacggatggatggactttggccgccgcagtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgccgcagtgctgaggaagaccagtag

SEQ ID NO: 182 - DNA, 819 bp, Artificial Sequence
  luciferase fusion protein
atgcagcgactatgtgtgtatgtgctgatctttgcactggctctggccgccttctctgaagcttcttggaagccccgctcccagcagccagatgcacccttaggtacaggggccaacagggacctggagctaccctggctggagcagcagggcccagcctctcatcatcgaaggcagctgggaccccagggtcccccacacctcgtggcagacccgtccaagaagcagggaccatggctggaggaagaagaagaagcctatggatggatggacttcggccgccgcagtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgccgcagtgctgaggatgagaactaa

SEQ ID NO: 183 - DNA, 903 bp, Artificial Sequence
  luciferase fusion protein
atgaaaatcctcgtggccgtggcggtcttttttctcgtttccactcaactgtttgcagaggaaatcgatgccaacgatgatctaaattattggtccgactggtccgacagtgaccagatcaaggaggcaatgccggagccctttgagcatcttctgcagagaatcgcccgaagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgaagacccaagcctcagcagttctttggattaatgggcaagcgggatgctgattcctcagttgaaaaacaagtggccctgttaaaggctctttatggacatggccagatctctcacaaaaggcataaaacagattcctttgttggactaatgggcaaaagagctttaaattctgtggcttatgaaagaagcgcgatgcagaactacgaaagaagacgtaaataa

SEQ ID NO: 184 - DNA, 900 bp, Artificial Sequence
  luciferase fusion protein
atgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaa

SEQ ID NO: 185 - DNA, 1317 bp, Artificial Sequence
  luciferase fusion protein
atggcgcggttcctgaggctttgcacctggctgctggcgcttgggtcctgcctcctggctacagtgcaggcggaatgcagccaggactgcgctaaatgcagctaccgcctggttcgcccaggcgacatcaatttcctggcgtgcacactggaatgtgaaggacagctgccttctttcaaaatctgggagacctgcaaggatctcctgcaggtgtccaggcccgagttcccttgggataacatcgacatgtacaaagacagcagcaaacaggatgagagccacttgctagccaagaagtacggaggcttcatgaaacggtacggaggcttcatgaagaagatggacgagctatatcccatggagccagaagaagaagcgaacggaggagagatccttgccaagaggtatggcggcttcatgaagaaggatgcagatgagggagacaccttggccaactcctccgatctgctgaaagagctactgggaacgggagacaaccgtgcgaaagacagccaccaacaagagagcaccaacaatgacgaagacatgagcaagaggtatgggggcttcatgagaagcctcaaaagaagcccccaactggaagatgaagcaaaagagctgcagaagcgctacgggggcttcatgagaaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacagaagggtgggacgccccgagtggtggatggactaccagaagaggtatgggggcttcctgaagcgctttgctgagtctctgccctccgatgaagaaggcgaaaattactcgaaagaagttcctgagatagagaaaagatacgggggctttatgcggttctga

SEQ ID NO: 186 - DNA, 1314 bp, Artificial Sequence
  luciferase fusion protein
atggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaa

SEQ ID NO: 187 - DNA, 1257 bp, Artificial Sequence
  luciferase fusion protein
atggcgtggtccaggctgatgctggcagcttgcctcctcgtgatgccctctaatgttatggcggactgcctgtccctgtgctccctgtgtgcagtgaggattcaggatgggccccgtcccatcaaccccctgatttgctccctggagtgccaggacctggtgccgccctcagaggagtgggagacatgccggggcttctcatcttttctcaccctgacggtctctgggctccgtggcaaggatgacttggaagatgaggttgctttggaagaaggctacagtgcactagccaagctcttggaacccgtcctgaaggagctggagaaaagccgactccttaccagcgtcccagaggaaaagttcaggggtctctccagcagctttggcaacggaaaagaatctgagctggcgggtgctgaccggatgaatgatgaagccgcacaggcgggcacgctccattttaatgaggaggacttgagaaaacaggccaaacgctatggcggctttttgcgcaaataccccaagaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagaggagttccgagatggcccgggatgaggacgggggccaggatggggatcaggtagggcatgaggacctgtacaaacgctatgggggcttcctgcggcgcattcgccccaagctgaagtgggacaaccagaagcgctatggtggtttcctgcggcgtcagttcaaggtggtgacgcggtcccaggagaaccccaatacctattctgaagatttagatgtttga

SEQ ID NO: 188 - DNA, 1275 bp, Artificial Sequence
  luciferase fusion protein
atggcctggcaggggctggtcctggctgcctgcctcctcatgttcccctccaccacagcggactgcctgtcgcggtgctccttgtgtgctgtaaagacccaggatggtcccaaacctatcaatcccctgatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataa

SEQ ID NO: 189 - DNA, 999 bp, Artificial Sequence
  luciferase fusion protein
atggggaaaatcagcagccttccaactcaattatttaagatctgcctctgtgacttcttgaagataaagatacacatcatgtcgtcttcacacctcttctacctggcgctctgcttgctcaccttcaccagctccaccacagctggaccagagaccctttgcggggctgagctggtggatgctcttcagttcgtgtgtggaccgaggggcttttacttcaacaagcccacaggctatggctccagcattcggaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactccagcattcggagggcacctcagacaggcattgtggatgagtgttgcttccggagctgtgatctgaggagactggagatgtactgtgccccactgaagcctacaaaagcagcccgctctatccgtgcccagcgccacactgacatgcccaagactcagaagtccccgtccctatcgacaaacaagaaaacgaagctgcaaaggagaaggaaaggaagtacatttgaagaacacaagtag

SEQ ID NO: 190 - DNA, 992 bp, Artificial Sequence
  luciferase fusion protein
atgggaaaaatcagcagtcttccaacccaattatttaagtgctgcttttgtgatttcttgaaggtgaagatgcacaccatgtctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtag

SEQ ID NO: 191 - DNA, 1089 bp, Artificial Sequence
  luciferase fusion protein
atgggcggcagcgtcgccggcttccaggtaccaatggggatcccagtggggaagtcgatgttggtgcttctcatctctttggccttcgccttgtgctgcatcgctgcttacggccccggagagactctgtgcggaggggagcttgttgacacgcttcagtttgtctgttcggaccgcggcttctacttcagcaggccttcaagccgtgccaaccgtcgcagccgtggcatcgtggaagagtgctgcttccgcagctgcgacctggccctcctggagacatactgtgccacccccgccaagtccgagagggacaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacgagagggacgtgtctacctctcaggccgtacttccggacgacttccccagataccccgtgggcaagttcttccaatatgacacctggagacagtccgcgggacgcctgcgcagaggcctgcctgccctcctgcgtgcccgccggggtcgcatgcttgccaaagagctcaaagagttcagagaggccaaacgtcatcgtcccctgatcgtgttaccacccaaagaccccgcccacgggggagcctcttcggagatgtccagcaaccatcagtga

SEQ ID NO: 192 - DNA, 1056 bp, Artificial Sequence
  luciferase fusion protein
atgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtga

SEQ ID NO: 193 - DNA, 858 bp, Artificial Sequence
  luciferase fusion protein
atgatgtctgcaaacaccgtggctaaagtgatgatcatcatgctggcagtctgtcttcttacccaaacggatgggaaacccgtgaggaagagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagagagctgtcagtgaaatacagcttatgcacaacctgggcaaacacctggcctccatggagaggatgcaatggctgagaaggaagctgcaagatatgcacaattttgttagtcttggagtccaaatggctgccagagatggcagtcaccagaagcccaccaagaaggaggaaaatgtccttgttgatggcaatccaaaaagtcttggtgagggagacaaagctgatgtggatgtattagttaaatcaaaatctcagtaa

SEQ ID NO: 194 - DNA, 858 bp, Artificial Sequence
  luciferase fusion protein
atgatacctgcaaaagacatggctaaagttatgattgtcatgttggcaatttgttttcttacaaaatcggatgggaaatctgttaagaagagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttcccagaggccccgaaaaaaggaagacaatgtcttggttgagagccatgaaaaaagtcttggagaggcagacaaagctgatgtgaatgtattaactaaagctaaatcccagtga

SEQ ID NO: 195 - DNA, 1038 bp, Artificial Sequence
  luciferase fusion protein
atgctgcggaggctggttcagcagtggagtgtcctggtattcctgctcagctactccgtgccctcccgcgggcgttcggtggaggggcttggccgcaggctcaaacgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaaacgcgctgtgtctgaacatcagctactgcatgacaagggcaagtccatccaagacttgcgccgccgtttcttcctccaccatctgatcgcggagatccacacagccgaaatcagagctacctcggaggtgtcccccaactccaaacctgctcccaacaccaaaaaccaccccgtgcggtttgggtcagacgatgagggcagatacctaactcaggaaaccaacaaggtggagacgtacaaagaacagccactcaagacacccgggaagaagaagaaaggcaagcctgggaaacgcagagaacaggagaaaaagaagcgaaggactcggtctgcctggccaagcacagctgcgagtggcctgcttgaggaccccctgccccacacctccaggccctcgctggagcccagcttaaggacgcattga

SEQ ID NO: 196 - DNA, 1044 bp, Artificial Sequence
  luciferase fusion protein
atgcagcggagactggttcagcagtggagcgtcgcggtgttcctgctgagctacgcggtgccctcctgcgggcgctcggtggagggtctcagccgccgcctcaaaagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattga

SEQ ID NO: 197 - DNA, 798 bp, Artificial Sequence
  luciferase fusion protein
atgaggaccatctttctgctcactctgctgaccctggctgcgctctgtctctctgacctcacagatgccaagcccagcggccctgagtctgacaaagccttcatgtccaagcaggagggcaataaggtagtgaacagactccggcgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggcgctaccttggagcctcagtccccagcccagatcccctggagcccacccgggagcagtgtgagcttaaccctgcttgtgacgagctatcagaccagtatggcttgaagaccgcctacaaacgcatctatggtatcactatttag

SEQ ID NO: 198 - DNA, 813 bp, Artificial Sequence
  luciferase fusion protein
atgagagccctcacactcctcgccctattggccctggccgcactttgcatcgctggccaggcaggtgcgaagcccagcggtgcagagtccagcaaaggtgcagcctttgtgtccaagcaggagggcagcgaggtagtgaagagacccaggcgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctag

SEQ ID NO: 199 - DNA, 1011 bp, Artificial Sequence
  luciferase fusion protein
atgctgatgcccacctacttcctgctgccacttctgctgctcctaggaggtccaaggacaagcctctcccacaagttctacaacactggaccagtcttcagctgcctcaacacagccctatctgaggtcaagaagaacaagctggaagatgtgcccttgctgagcaagaagagctttggccacctgcccacacaagacccctcaggggaagaagatgacaaccaaacgcacctccagatcaaaagaactttctcaggtgccgcgggtgggaatggagctgggagcacccggtacagataccaatcccaggcacagcacaaggggaagctgtacccagacaagcccaaaagcgaccggggcaccaagaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggggcaccaagttcaccctttcccttgatgttcccactaacatcatgaacatcctcttcaacatcgacaaggccaagaatttgcgagccaaggcagctgccaatgctcagctcatggcacagattgggaagaagaagtaa

SEQ ID NO: 200 - DNA, 996 bp, Artificial Sequence
  luciferase fusion protein
atgctgatgccggtccacttcctgctgctcctgctgctgctcctggggggccccaggacaggcctcccccacaagttctacaaagccaagcccatcttcagctgcctcaacaccgccctgtctgaggctgagaagggccagtgggaggatgcatccctgctgagcaagaggagcttccactacctgcgcagcagagacgcctcttcgggagaggaggaggagggcaaagagaaaaagactttccccatctctggggccaggggtggagccagaggcacccggtacagatacgtgtcccaagcacagcccaggggaaagccacgccaggacacggccaagagtccccaccgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccaccgcaccaagttcaccctgtccctcgacgtccccaccaacatcatgaacctcctcttcaacatcgccaaggccaagaacctgcgtgcccaggcggccgccaatgcccacctgatggcgcaaattgggaggaagaagtag

SEQ ID NO: 201 - DNA, 855 bp, Artificial Sequence
  luciferase fusion protein
atgatgaccaggtgggcactggtggtgttcgtggtcctgatgttggataggatcctatttgtcccaggaactcctatccccaccttccagctcctccctcagaactctctggagacaactcctagctctgtgacctcagagagctcctcaggtaccaccacaggaccctcagcttcctggagcaactctaaagccagcccttacctagacacccgtgtcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacacccgtgtcatactctccctggatgttcccattggcctcctacggatcttactggaacaggctcgttacaaggctgccaggaatcaggctgccactaatgctcaaatactagcccatgttggccgccgctga

SEQ ID NO: 202 - DNA, 852 bp, Artificial Sequence
  luciferase fusion protein
atgaccaggtgtgctctgctgttgctgatggtcctgatgttgggcagagtcctggttgtcccagtgacccctatcccaaccttccagctccgccctcagaattctccccagaccactccccgacctgcggcctcagagagcccctcagctgctcccacatggccgtgggctgcccagagccactgcagccccacccgccaccctggctcgcgcattaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactcgcgcattgtcctatcgctggatgtccccatcggcctcttgcagatcttactggagcaagcccgggccagggctgccagggagcaggccaccaccaacgcccgcatcctggcccgtgtcggccactgctga

SEQ ID NO: 203 - DNA, 879 bp, Artificial Sequence
  luciferase fusion protein
atgatacagaggggacgcgctacgctcctggtggcgttgctgctcttggcacagcttcgcccggagagcagccagtggagcccagcggctgcggcggcaactggggtccaggatccgaatctgcgatggagccctggagtgcggaatcagggcggcggcgtccgcgcgctcctcttgctgttagcggagcgcttcccgcgccgcgcaggatctgagcctgcgggcgagcggcagcgacggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgacgggacgaccctccactgtccatcgacctcaccttccacctgctgcggaccctgctggagctagctcggacacagagccagcgcgagcgcgcagagcagaaccgcatcatattcgattcggtgggcaagtga

SEQ ID NO: 204 - DNA, 885 bp, Artificial Sequence
  luciferase fusion protein
atgaggcaggcgggacgcgcagcgctgctggccgcgctgctgctcctggtacagctgtgccctgggagcagccagaggagccccgaggcggccggggtccaggacccgagtctgcgctggagccccggggcacggaaccagggtggcggggcccgcgcgctcctcttgctgctggcggagcgcttcccgcgccgcgcggggcccggccgattgggactcgggacggcaggcgagcggccgcggcggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggcgggacaacccttctctgtccattgacctcacctttcacctgctgcggaccctgctggagctggcgcggacgcagagccagcgggagcgcgccgagcagaaccgcatcatattcgactcggtgggcaagtga

SEQ ID NO: 205 - DNA, 1266 bp, Artificial Sequence
  luciferase fusion protein
atgctagggacctgccttagactcctggtgggcgtgctctgcactgtctgcagcttgggcactgctagagcctatccggacacttccccattgcttggctccaactggggaagcctgacccacctgtacacggctacagccaggaccagctatcacctacagatccatagggatggtcatgtagatggcaccccccatcagaccatctacagtgccctgatgattacatcagaggacgccggctctgtggtgataacaggagccatgactcgaaggttcctttgtatggatctccacggcaacatttttggatcgcttcacttcagcccagagaattgcaagttccgccagtggacgctggagaatggctatgacgtctacttgtcgcagaagcatcactacctggtgagcctgggccgcgccaagcgcatcttccagccgggcaccaacccgccgcccttctcccagttcctggctcgcaggaacgaggtcccgctgctgcatttctacactgttcgcccacggcgccacacgcgcagcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgcagcgccgaggacccaccggagcgcgacccactgaacgtgctcaagccgcggccccgcgccacgcctgtgcctgtatcctgctctcgcgagctgccgagcgcagaggaaggtggccccgcagccagcgatcctctgggggtgctgcgcagaggccgtggagatgctcgcgggggcgcgggaggcgcggataggtgtcgcccctttcccaggttcgtctag

SEQ ID NO: 206 - DNA, 1266 bp, Artificial Sequence
  luciferase fusion protein
atgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgccctgatgatcagatcagaggatgctggctttgtggtgattacaggtgtgatgagcagaagatacctctgcatggatttcagaggcaacatttttggatcacactatttcgacccggagaactgcaggttccaacaccagacgctggaaaacgggtacgacgtctaccactctcctcagtatcacttcctggtcagtctgggccgggcgaagagagccttcctgccaggcatgaacccacccccgtactcccagttcctgtcccggaggaacgagatccccctaattcacttcaacacccccataccacggcggcacacccggagcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggagcgccgaggacgactcggagcgggaccccctgaacgtgctgaagccccgggcccggatgaccccggccccggcctcctgttcacaggagctcccgagcgccgaggacaacagcccgatggccagtgacccattaggggtggtcaggggcggtcgagtgaacacgcacgctgggggaacgggcccggaaggctgccgccccttcgccaagttcatctag

SEQ ID NO: 207 - DNA, 1338 bp, Artificial Sequence
  luciferase fusion protein
atggcaactgttcctgaactcaactgtgaaatgccaccttttgacagtgatgagaatgacctgttctttgaagttgacggaccccaaaagatgaagggctgcttccaaacctttgacctgggctgtcctgatgagagcatccagcttcaaatctcgcagcagcacatcaacaagagcttcaggcaggcagtatcactcattgtggctgtggagaagctgtggcagctacctgtgtctttcccgtggaccttccaggatgaggacatgagcaccttcttttccttcatctttgaagaagagcccatcctctgtgactcatgggatgatgatgataacctgctggtgtgtgacgttcccaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctggtgtgtgacgttcccgttcccattagacaactgcactacaggctccgagatgaacaacaaaaaagcctcgtgctgtcggacccatatgagctgaaagctctccacctcaatggacagaatatcaaccaacaagtgatattctccatgagctttgtacaaggagaaccaagcaacgacaaaatacctgtggccttgggcctcaaaggaaagaatctatacctgtcctgtgtaatgaaagacggcacacccaccctgcagctggagagtgtggatcccaagcaatacccaaagaagaagatggaaaaacggtttgtcttcaacaagatagaagtcaagagcaaagtggagtttgagtctgcagagttccccaactggtacatcagcacctcacaagcagagcacaagcctgtcttcctgggaaacaacagtggtcaggacataattgacttcaccatggaatccgtgtcttcctaa

SEQ ID NO: 208 - DNA, 1332 bp, Artificial Sequence
  luciferase fusion protein
atggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaa

SEQ ID NO: 209 - DNA, 1218 bp, Artificial Sequence
  luciferase fusion protein
atgagcacagaaagcatgatccgcgacgtggaactggcagaagaggcactcccccaaaagatggggggcttccagaactccaggcggtgcctatgtctcagcctcttctcattcctgcttgtggcaggggccaccacgctcttctgtctactgaacttcggggtgatcggtccccaaagggatgagaagttcccaaatggcctccctctcatcagttctatggcccagaccctcacactcagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcagatcatcttctcaaaattcgagtgacaagcctgtagcccacgtcgtagcaaaccaccaagtggaggagcagctggagtggctgagccagcgcgccaacgccctcctggccaacggcatggatctcaaagacaaccaactagtggtgccagccgatgggttgtaccttgtctactcccaggttctcttcaagggacaaggctgccccgactacgtgctcctcacccacaccgtcagccgatttgctatctcataccaggagaaagtcaacctcctctctgccgtcaagagcccctgccccaaggacacccctgagggggctgagctcaaaccctggtatgagcccatatacctgggaggagtcttccagctggagaagggggaccaactcagcgctgaggtcaatctgcccaagtacttagactttgcggagtccgggcaggtctactttggagtcattgctctgtga

SEQ ID NO: 210 - DNA, 1212 bp, Artificial Sequence
  luciferase fusion protein
atgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacgtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtga

SEQ ID NO: 211 - DNA, 972 bp, Artificial Sequence
  luciferase fusion protein
atgaacgctacacactgcatcttggctttgcagctcttcctcatggctgtttctggctgttactgccacggcacagtcattgaaagcctagaaagtctgaataactattttaactcaagtggcatagatgtggaagaaaagagtctcttcttggatatctggaggaactggcaaaaggatggtgacatgaaaatcctgcagagccagattatctctttctacctcagactctttgaagtcttgaaagacaatcaggccatcagcaacaacataagcgtcattgaatcacacctgattactaccttcttcagcaacagcaaggcgaaaaaggatgcattcatgagtattgccaagtttgaggtcaacaacccacaggtccagcgccaagcattcaatgagctcatccgagtggtccaccagctgttgccggaatccagcctcaggaagaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggaaaaggagtcgctgctga

SEQ ID NO: 212 - DNA, 1014 bp, Artificial Sequence
  luciferase fusion protein
atgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacggtcgaagagcatcccagtaa

SEQ ID NO: 213 - DNA, 3087 bp, Artificial Sequence
  luciferase fusion protein
atggagcggccccggggagctgcggacggccttttgcgctggcccctcggcctcctcctgctccttcaactgctgcctcctgccgccgtcggccaggaccggctggacgcgccgccgccgcccgcgcctcctctgctgcgctgggccggtccggtcggggtgagctgggggctgcgcgccgccgcgcccgggggccccgtcccccgcgctggccgttggcgccgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgccgcggcgcgcccgccgaggaccaagactgcggccgcctcccggacttcatcgccaagctgaccaacaatacgcaccagcatgtctttgatgacctcagtggctcagtgtccttgtcctgggttggagacagcactggggttattctcgtcctgaccactttccaagtgcctctggtaattgtgagctttggacagtccaagttgtatcgaagtgaggattatggaaagaactttaaggatattacaaatctcatcaataacaccttcattcggacggaatttggcatggctattggtcctgagaactctggaaaggtgatactaacagcggaggtgtccgggggaagccgaggcggaagagtgttcaggtcatcagactttgccaagaactttgtgcaaacagatctcccctttcatcctctgacgcagatgatgtacagccctcagaattctgattacctgttagctctcagcaccgaaaatggcctgtgggtgtccaagaattttggggaaaaatgggaagaaatccacaaagcagtatgtttggccaaatggggaccaaacaacatcatcttctttaccacccatgtgaatggctcctgcaaagctgatcttggtgccctggaattatggagaacatccgacttgggaaaaaccttcaaaaccattggtgtgaaaatctactcctttggtcttgggggccgtttcctttttgcctctgtgatggctgataaggacacaacaagaaggatccatgtgtcaacagaccagggggacacatggagcatggcacaacttccttctgtgggacaggaacagttctactccatcctggcagccaatgaggacatggtcttcatgcatgtagatgaacctggagataccgggtttggcaccatctttacctctgatgatcgaggcattgtctactccaagtctctggacagacatctctataccaccacaggcggggagacggactttaccaacgtgacttccctccgtggggtctatataacaagcacgctctcagaagataactctattcagagcatgatcacttttgaccagggaggacggtgggagcacctgcggaagccggagaacagcaagtgcgacgctaccgcaaagaacaagaacgagtgcagccttcatatccatgcttcttatagcatctcccagaagctaaacgttccaatggccccactttccgagcccaatgctgtgggcatagtcatcgctcacggtagtgtgggagatgccatctcggtgatggtcccagatgtgtacatctcagatgatgggggttactcctgggcgaagatgctagaaggaccacattactataccatcctggactctggaggcatcattgtggccattgagcacagcaaccgtcctatcaatgtgattaagttctccacagatgaaggccagtgctggcagagctatgtgttcacacaggagcccatctacttcactgggcttgcttccgagcctggagccaggtccatgaacatcagcatctggggattcacagagtctttcattacccgccagtgggtctcctacacagtcgatttcaaagacatccttgagcggaattgtgaagaggatgactataccacgtggctggcacactccacagaccctggagattacaaagacggctgcattttgggctataaagaacagttcctacggctacggaagtcatccgtctgtcagaatggtcgagactatgttgtggccaagcagccatccgtctgtccgtgttccctggaggacttcctctgtgactttggctacttccgtccggagaacgcctcagagtgcgtggagcagcctgaactgaaggggcatgagttagagttctgtctgtacggcaaggaggagcacctgacaacaaatgggtaccggaaaatcccaggagacaaatgccaaggtgggatgaatcccgccagagaagtaaaagacttgaaaaagaaatgcacaagcaacttcttgaaccccacaaagcaggactcccgcccacagggacacagcttgtcccagaatccagctccgcctcctcttggatacactgaaaacacacacttcctatctcctacccagaagcagaattccaagtcaaattctgtccctattatcctggccatcgtgggactgatgcttgtcacagtcgtagcaggagtcctcattgtgaagaaatatgtctgtggcggaaggttcctggtgcaccggtactcggtgctacagcagcacgcagaggctgacggcgtagaggctttggattcaacctcccacgctaaaagcggatatcacgacgactcagatgaggacctcctggaatag

SEQ ID NO: 214 - DNA, 3006 bp, Artificial Sequence
  luciferase fusion protein
atggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatctttagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggatacaacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatag

SEQ ID NO: 215 - DNA, 1041 bp, Artificial Sequence
  luciferase fusion protein
ctggcgtctaacagagaagtgcggggccctgggcccgggactcccaggaaccggcccctgctgcccctgctgctgcttctgctcttgctaccgctgcccgccagcgcctggtataagcacgtggcgagtccccgctatcacacagtgggtcgtgcctccgggctgctcatggggctgcgccgctcgccctaccagtggcgccgtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgccgtgccctgggcggggctgctggacccctctcccggctcccaggaccggtcgcccgcggcgctctcctgcttccttcctcagggcaggagctgtgggaggtacgaagcaggagctcacctgcagggcttcccgtccatgcaccctggagtccgcgggacctggagggagtccgccaaccggagcagtcgctaagccttcactcctggatctcagaggagcccgctgctagagccttcggagagacgcttcgtgcccagccatggttcctgcagcaagtcatctttgccgatcctgtcaggcccaagaaccgatggcgcccccatgcttga

SEQ ID NO: 216 - DNA, 1008 bp, Artificial Sequence
  luciferase fusion protein
ctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgccgcgcgctgcgcgcggccgccgggcccctggccagggacaccctctcccccgaacccgcagcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccagagacttcggagagacgtctcccgcccagcggtggaccccgcagcaaaccgccttggcctgccctgcctggcccccggaccgttctga

SEQ ID NO: 217 - DNA, 861 bp, Artificial Sequence
  luciferase fusion protein
atggagagctcccgcctgcggctgctacccctcctgggcgccgccctgctgctactgctacctttgctgggtgcccgtgcccaggaggacgccgagctgcagccccgagccctggacatctactctgccgtggatgatgcgtcccacgagaaggagctgatcgaagcgttgcaagaagtcctgaagaagctcaagagtaaacgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaaacgcattccgatctacgagaagaagtacggccaagtccccatgtgtgacgctggagagcagtgcgcagtgaggaaaggggccaggatcgggaagctgtgtgactgtccccgaggaacttcctgcaattctttcctcttgaagtgcttgtga

SEQ ID NO: 218 - DNA, 861 bp, Artificial Sequence
  luciferase fusion protein
atggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctgatcgaagcgctgcaagaagtcttgaagaagctcaagagtaaacgtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaaacgtgttcccatctatgagaagaagtatggccaagtccccatgtgtgacgccggtgagcagtgtgcagtgaggaaaggggcaaggatcgggaagctgtgtgactgtccccgaggaacctcctgcaattccttcctcctgaagtgcttatga

SEQ ID NO: 219 - DNA, 1683 bp, Artificial Sequence
  luciferase fusion protein
atgccgccctcggggctgcggctactgccgcttctgctcccactcccgtggcttctagtgctgacgcccgggaggccagccgcgggactctccacctgcaagaccatcgacatggagctggtgaaacggaagcgcatcgaagccatccgtggccagatcctgtccaaactaaggctcgccagtcccccaagccagggggaggtaccgcccggcccgctgcccgaggcggtgctcgctttgtacaacagcacccgcgaccgggtggcaggcgagagcgccgacccagagccggagcccgaagcggactactatgctaaagaggtcacccgcgtgctaatggtggaccgcaacaacgccatctatgagaaaaccaaagacatctcacacagtatatatatgttcttcaatacgtcagacattcgggaagcagtgcccgaacccccattgctgtcccgtgcagagctgcgcttgcagagattaaaatcaagtgtggagcaacatgtggaactctaccagaaatatagcaacaattcctggcgttaccttggtaaccggctgctgacccccactgatacgcctgagtggctgtcttttgacgtcactggagttgtacggcagtggctgaaccaaggagacggaatacagggctttcgattcagcgctcactgctcttgtgacagcaaagataacaaactccacgtggaaatcaacgggatcagccccaaacgtcggggcgacctgggcaccatccatgacatgaaccggcccttcctgctcctcatggccacccccctggaaagggcccagcacctgcacagctcacggcaccggagaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggagagccctggataccaactattgcttcagctccacagagaagaactgctgtgtgcggcagctgtacattgactttaggaaggacctgggttggaagtggatccacgagcccaagggctaccatgccaacttctgtctgggaccctgcccctatatttggagcctggacacacagtacagcaaggtccttgccctctacaaccaacacaacccgggcgcttcggcgtcaccgtgctgcgtgccgcaggctttggagccactgcccatcgtctactacgtgggtcgcaagcccaaggtggagcagttgtccaacatgattgtgcgctcctgcaagtgcagctga

SEQ ID NO: 220 - DNA, 1683 bp, Artificial Sequence
  luciferase fusion protein
atgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctga

SEQ ID NO: 221 - DNA, 1755 bp, Artificial Sequence
  luciferase fusion protein
atgcactactgtgtgctgagcacctttttgctcctgcatctggtcccggtggcgctcagtctgtctacctgcagcaccctcgacatggatcagtttatgcgcaagaggatcgaggccatccgcgggcagatcctgagcaagctgaagctcaccagccccccggaagactatccggagccggatgaggtccccccggaggtgatttccatctacaacagtaccagggacttactgcaggagaaggcaagccggagggcagccgcctgcgagcgcgagcggagcgacgaggagtactacgccaaggaggtttataaaatcgacatgccgtcccacctcccctccgaaaatgccatcccgcccactttctacagaccctacttcagaatcgtccgctttgatgtctcaacaatggagaaaaatgcttcgaatctggtgaaggcagagttcagggtcttccgcttgcaaaaccccaaagccagagtggccgagcagcggattgaactgtatcagatccttaaatccaaagacttaacatctcccacccagcgctacatcgatagcaaggttgtgaaaaccagagcggagggtgaatggctctccttcgacgtgacagacgctgtgcaggagtggcttcaccacaaagacaggaacctggggtttaaaataagtttacactgcccctgctgtaccttcgtgccgtctaataattacatcatcccgaataaaagcgaagagctcgaggcgagatttgcaggtattgatggcacctctacatatgccagtggtgatcagaaaactataaagtccactaggaaaaaaaccagtgggaagaccccacatctcctgctaatgttgttgccctcctacagactggagtcacaacagtccagccggcggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggcggaagaagcgcgctttggatgctgcctactgctttagaaatgtgcaggataattgctgccttcgccctctttacattgattttaagagggatcttggatggaaatggatccatgaacccaaagggtacaatgctaacttctgtgctggggcatgcccatatctatggagttcagacactcaacacaccaaagtcctcagcctgtacaacaccataaatcccgaagcttccgcttccccttgctgtgtgtcccaggatctggaaccactgaccattctctattacattggaaatacgcccaagatcgaacagctttccaatatgattgtcaagtcttgtaaatgcagctaa

SEQ ID NO: 222 - DNA, 1839 bp, Artificial Sequence
  luciferase fusion protein
atgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaa

SEQ ID NO: 223 - DNA, 1749 bp, Artificial Sequence
  luciferase fusion protein
atgaagatgcacttgcaaagggctctggtagtcctggccctgctgaacttggccacaatcagcctctctctgtccacttgcaccacgttggacttcggccacatcaagaagaagagggtggaagccattaggggacagatcttgagcaagctcaggctcaccagcccccctgagccatcggtgatgacccacgtcccctatcaggtcctggcactttacaacagcacccgggagttgctggaagagatgcacggggagagggaggaaggctgcactcaggagacctcggagtctgagtactatgccaaagagatccataaattcgacatgatccagggactggcggagcacaatgaactggccgtctgccccaaaggaattacctctaaggtttttcgtttcaatgtgtcctcagtggagaaaaatggaaccaatctgttccgggcagagttccgggtcttgcgggtgcccaaccccagctccaagcgcacagagcagagaattgagctcttccagatacttcgaccggatgagcacatagccaagcagcgctacataggtggcaagaatctgcccacaaggggcaccgctgaatggctgtctttcgatgtcactgacactgtgcgcgagtggctgttgaggagagagtccaacttgggtctggaaatcagcatccactgtccatgtcacacctttcagcccaatggagacatactggaaaatgttcatgaggtgatggaaatcaaattcaaaggagtggacaatgaagatgaccatggccgtggagacctggggcgtctcaagaagcaaaaggatcaccacaacccacacctgatcctcatgatgatccccccacaccgactggacagcccaggccagggcagtcagaggaagaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaggaagaagagggccctggacaccaattactgcttccgcaacctggaggagaactgctgtgtacgccccctttatattgacttccggcaggatctaggctggaaatgggtccacgaacctaagggttactatgccaacttctgctcaggcccttgcccatacctccgcagcgcagacacaacccatagcacggtgcttggactatacaacaccctgaacccagaggcgtctgcctcgccatgctgcgtcccccaggacctggagcccctgaccatcttgtactatgtgggcagaacccccaaggtggagcagctgtccaacatggtggtgaagtcgtgtaagtgcagctga

SEQ ID NO: 224 - DNA, 1749 bp, Artificial Sequence
  luciferase fusion protein
atgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctga

SEQ ID NO: 225 - DNA, 1101 bp, Artificial Sequence
  luciferase fusion protein
atgaggacctgggcttgcctgctgctcctcggctgcggatacctcgcccatgccctggccgaggaagccgagataccccgggagttgatcgagcggctggctcgaagtcagatccacagcatccgggacctccagcgactcttggagatagactccgtaggggctgaggatgccttggagacaagtctgagagcccatgggtcccatgccattaaccatgtgcccgagaagcggcctgtgcccattcgcaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgcaggaagagaagtattgaggaagccattcctgcagtttgcaagaccaggacggtcatttacgagatacctcggagccaggtggaccccacatcggccaacttcctgatctggcccccatgtgtggaggtgaagcgctgcactggctgttgtaacaccagcagcgtcaagtgccagccttcacgggtccaccaccgcagtgtcaaggtggccaaagtggagtatgtcaggaagaagccaaaattgaaagaggtccaggtgaggttagaggaacacctggagtgtgcatgtgcgacctccaacctgaacccagaccatcgggaggaggagacagatgtgaggtga

SEQ ID NO: 226 - DNA, 1146 bp, Artificial Sequence
  luciferase fusion protein
atgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacgggaaggcctagggagtcaggtaaaaaacggaaaagaaaaaggttaaaacccacctaa

SEQ ID NO: 227 - DNA, 1284 bp, Artificial Sequence
  luciferase fusion protein
atgttccaccaggtgagaagagtgatgaccatccttttccttactatggttatttcatacttcggttgcatgaaggcggcgcccatgaaagaagtaaacgtccacggacaaggcaacttggcctacccaggtgtgcggacccatgggactctggagagcgtgaatgggcccagggcaggttcgagaggtctgacgacgacatcactggctgacacttttgagcacgtcatcgaagagctgctggatgaggaccagaaggttcggcccaacgaagaaaaccataaggacgcggacttgtacacttcccgggtgatgctcagcagtcaagtgcctttggagcctcctctactctttctgctggaggaatacaaaaattacctggatgccgcaaacatgtctatgagggttcggcgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccggcgccactccgaccctgcccgccgtggggagctgagcgtgtgtgacagtattagcgagtgggtcacagcggcagataaaaagactgcagtggacatgtctggcgggacggtcacagtcctagagaaagtcccggtatccaaaggccaactgaagcagtatttctacgagaccaagtgtaatcccatgggttacaccaaggaaggctgcaggggcatagacaaaaggcactggaactcgcaatgccgaactacccaatcgtatgttcgggcccttactatggatagcaaaaagagaattggctggcgattcataaggatagacacttcctgtgtatgtacactgaccattaaaaggggaagatag

SEQ ID NO: 228 - DNA, 1254 bp, Artificial Sequence
  luciferase fusion protein
atgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatag

SEQ ID NO: 229 - DNA, 1236 bp, Artificial Sequence
  luciferase fusion protein
atgtccatgttgttctacactctgatcactgcgtttttgatcggcgtacaggcagaaccgtacacagatagcaatgtcccagaaggagactctgtccctgaagcccactggactaaacttcagcattcccttgacacagccctccgcagagcccgcagtgcccctactgcaccaatagctgcccgagtgacagggcagacccgcaacatcactgtagaccccagactgtttaagaaacggagactccactcaccccgtgtgctgttcagcacccagcctccacccacctcttcagacactctggatctagacttccaggcccatggtacaatccctttcaacaggactcaccggagcaagcgcaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcgctcatccacccacccagtcttccacatgggggagttctcagtgtgtgacagtgtcagtgtgtgggttggagataagaccacagccacagacatcaagggcaaggaggtgacagtgctggccgaggtgaacattaacaacagtgtattcagacagtacttttttgagaccaagtgccgagcctccaatcctgttgagagtgggtgccggggcatcgactccaaacactggaactcatactgcaccacgactcacaccttcgtcaaggcgttgacaacagatgagaagcaggctgcctggaggttcatccggatagacacagcctgtgtgtgtgtgctcagcaggaaggctacaagaagaggctga

SEQ ID NO: 230 - DNA, 1236 bp, Artificial Sequence
  luciferase fusion protein
atgtccatgttgttctacactctgatcacagcttttctgatcggcatacaggcggaaccacactcagagagcaatgtccctgcaggacacaccatcccccaagcccactggactaaacttcagcattcccttgacactgcccttcgcagagcccgcagcgccccggcagcggcgatagctgcacgcgtggcggggcagacccgcaacattactgtggaccccaggctgtttaaaaagcggcgactccgttcaccccgtgtgctgtttagcacccagcctccccgtgaagctgcagacactcaggatctggacttcgaggtcggtggtgctgcccccttcaacaggactcacaggagcaagcggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcggtcatcatcccatcccatcttccacaggggcgaattctcggtgtgtgacagtgtcagcgtgtgggttggggataagaccaccgccacagacatcaagggcaaggaggtgatggtgttgggagaggtgaacattaacaacagtgtattcaaacagtacttttttgagaccaagtgccgggacccaaatcccgttgacagcgggtgccggggcattgactcaaagcactggaactcatattgtaccacgactcacacctttgtcaaggcgctgaccatggatggcaagcaggctgcctggcggtttatccggatagatacggcctgtgtgtgtgtgctcagcaggaaggctgtgagaagagcctga

SEQ ID NO: 231 - DNA, 2337 bp, Artificial Sequence
  luciferase fusion protein
atgaagtgggtaacctttctcctcctcctcttcgtctccggctctgctttttccaggggtgtgtttcgccgaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgccgagaagcacacaagagtgagatcgcccatcggtataatgatttgggagaacaacatttcaaaggcctagtcctgattgccttttcccagtatctccagaaatgctcatacgatgagcatgccaaattagtgcaggaagtaacagactttgcaaagacgtgtgttgccgatgagtctgccgccaactgtgacaaatcccttcacactctttttggagataagttgtgtgccattccaaacctccgtgaaaactatggtgaactggctgactgctgtacaaaacaagagcccgaaagaaacgaatgtttcctgcaacacaaagatgacaaccccagcctgccaccatttgaaaggccagaggctgaggccatgtgcacctcctttaaggaaaacccaaccacctttatgggacactatttgcatgaagttgccagaagacatccttatttctatgccccagaacttctttactatgctgagcagtacaatgagattctgacccagtgttgtgcagaggctgacaaggaaagctgcctgaccccgaagcttgatggtgtgaaggagaaagcattggtctcatctgtccgtcagagaatgaagtgctccagtatgcagaagtttggagagagagcttttaaagcatgggcagtagctcgtctgagccagacattccccaatgctgactttgcagaaatcaccaaattggcaacagacctgaccaaagtcaacaaggagtgctgccatggtgacctgctggaatgcgcagatgacagggcggaacttgccaagtacatgtgtgaaaaccaggcgactatctccagcaaactgcagacttgctgcgataaaccactgttgaagaaagcccactgtcttagtgaggtggagcatgacaccatgcctgctgatctgcctgccattgctgctgattttgttgaggaccaggaagtgtgcaagaactatgctgaggccaaggatgtcttcctgggcacgttcttgtatgaatattcaagaagacaccctgattactctgtatccctgttgctgagacttgctaagaaatatgaagccactctggaaaagtgctgcgctgaagccaatcctcccgcatgctacggcacagtgcttgctgaatttcagcctcttgtagaagagcctaagaacttggtcaaaaccaactgtgatctttacgagaagcttggagaatatggattccaaaatgccattctagttcgctacacccagaaagcacctcaggtgtcaaccccaactctcgtggaggctgcaagaaacctaggaagagtgggcaccaagtgttgtacacttcctgaagatcagagactgccttgtgtggaagactatctgtctgcaatcctgaaccgtgtgtgtctgctgcatgagaagaccccagtgagtgagcatgttaccaagtgctgtagtggatccctggtggaaaggcggccatgcttctctgctctgacagttgatgaaacatatgtccccaaagagtttaaagctgagaccttcaccttccactctgatatctgcacacttccagagaaggagaagcagattaagaaacaaacggctcttgctgagctggtgaagcacaagcccaaggctacagcggagcaactgaagactgtcatggatgactttgcacagttcctggatacatgttgcaaggctgctgacaaggacacctgcttctcgactgagggtccaaaccttgtcactagatgcaaagacgccttagcctaa

SEQ ID NO: 232 - DNA, 2340 bp, Artificial Sequence
  luciferase fusion protein
atgaagtgggtaacctttatttcccttctttttctctttagctcggcttattccaggggtgtgtttcgtcgaaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgaccgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataa

SEQ ID NO: 233 - DNA, 921 bp, Artificial Sequence
  luciferase fusion protein
atgggcttcctgaagttctcccctttcctggttgtcagcatcttgctcctgtaccaggcatgcagcctccaggcagtgcctttgaggtcaatcttggaaagcagcccaggcatggccactctcagtgaagaagaagttcgcctgctggctgcactggtgcaggactatatgcagatgaaagccagggagctggagcaggaggaagagcaggaggctgagggctctagcttggacagccccagatctaagcggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcggtgtgggaatctgagtacctgcatgctgggcacgtacacacaagacctcaacaagtttcacaccttcccccaaacttcaattggggttgaagcacctggcaagaaaagggatgtggccaaggacttggagacaaaccaccaatcccattttggcaactaa

SEQ ID NO: 234 - DNA, 936 bp, Artificial Sequence
  luciferase fusion protein
atgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaa

SEQ ID NO: 235 - DNA, 1920 bp, Artificial Sequence
  luciferase fusion protein
atgatgtgcatctccaaactgccagctgtcctcctcatcctctctgtggcactgaaccacttgagagctacacctgtcagaagtggtagcaaccctcagatggacaaacggaagtgcaacacggccacgtgtgccacacaacgcctggcaaactttttggttcgttccagcaacaaccttggtccagtcctcccaccaaccaacgtgggatcgaatacatatggcaagaggaatgcgtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagaggaatgcggcaggggatccaaatagggaatccttggatttcttactcgtttaa

SEQ ID NO: 236 - DNA, 1908 bp, Artificial Sequence
  luciferase fusion protein
atgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagaggaatgcggtagaggttttaaagagagagccactgaattacttgcccctttag

SEQ ID NO: 237 - DNA, 1965 bp, Artificial Sequence
  luciferase fusion protein
atggccctgtggatgcgcttcctgcccctgctggccctgctcttcctctgggagtcccaccccacccaggcttttgtcaagcagcacctttgtggttcccacctggtggaggctctctacctggtgtgtggggagcgtggcttcttctacacacccatgtcccgccgtgaagtggaggacccacaagtggcacaactggagctgggtggaggcccgggagcaggtgaccttcagaccttggcactggaggtggcccagcagaagaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgtggcattgtagatcagtgctgcaccagcatctgctccctctaccagctggagaactactgcaactag

SEQ ID NO: 238 - DNA, 1965 bp, Artificial Sequence
  luciferase fusion protein
atggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgtggcattgtggaacaatgctgtaccagcatctgctccctctaccagctggagaactactgcaactag

SEQ ID NO: 239 - DNA, 2190 bp, Artificial Sequence
  luciferase fusion protein
atgaagaccatttactttgtggctggattgcttataatgctggtgcaaggcagctggcagcacgcccttcaagacacagaggagaaccccagatcattcccagcttcccagacagaagcgcatgaggaccctgatgagatgaatgaagacaaacgccactcacagggcacattcaccagcgactacagcaaatacctggactcccgccgtgcccaagattttgtgcagtggttgatgaacaccaagaggaaccggaacaacattgccaaacgtcatgatgaatttgagaggcatgctgaagggacctttaccagtgatgtgagttcttacttggagggccaggcagcaaaggaattcattgcttggctggtgaaaggccgaggaaggcgagacttcccagaagaagtcgccattgccgaggaactcggccgaaagagaagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgcggccgcaggcacgctgatggctccttctctgacgagatgagcaccattctggataatcttgccaccagggacttcatcaactggctgattcaaaccaagatcactgacaagaaatag

SEQ ID NO: 240 - DNA, 2190 bp, Artificial Sequence
  luciferase fusion protein
atgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgaaagagaagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgcggccgcagacatgctgatggttctttctctgatgagatgaacaccattcttgataatcttgccgccagggactttataaactggttgattcagaccaaaatcactgacaggaaataa

SEQ ID NO: 241 - DNA, 1932 bp, Artificial Sequence
  luciferase fusion protein
atggtggcggtgcgcaggccttggcccgtcacggtcgcaatgctgctaatcctgctcgcctgtctgggagccctggtggacgcctaccctgccaaaccagaggctcccggcgaagacgcctccccggaggagctgagccgctactacgcctccctgcgccactacctcaacctggtcacccggcagcggtatggaaaaagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagaggagggatgtccccgcagctctgttctccaaactgctcttcacagacgacagcgacagcgagaacctccccttcaggccagaaggtttggaccagtggtga

SEQ ID NO: 242 - DNA, 1929 bp, Artificial Sequence
  luciferase fusion protein
atggtgttcgtgcgcaggccgtggcccgccttgaccacagtgcttctggccctgctcgtctgcctaggggcgctggtcgacgcctaccccatcaaacccgaggctcccggcgaagacgcctcgccggaggagctgaaccgctactacgcctccctgcgccactacctcaacctggtcacccggcagcggtatgggaaaagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagaggagggacggcccggacacgcttctttccaaaacgttcttccccgacggcgaggaccgccccgtcaggtcgcggtcggagggcccagacctgtggtga

SEQ ID NO: 243 - DNA, 1929 bp, Artificial Sequence
  luciferase fusion protein
atgctaggtaacaagcgaatggggctgtgtggactgaccctcgctctatctctgctcgtgtgtttgggcattctggctgaggggtacccctccaagccggacaatccgggcgaggacgcgccagcagaggacatggccagatactactccgctctgcgacactacatcaatctcatcaccagacagagatatggcaagagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagaggaggtccagccctgagacactgatttcagacctcttaatgaaggaaagcacagaaaacgcccccagaacaaggcttgaagacccttccatgtggtga

SEQ ID NO: 244 - DNA, 1929 bp, Artificial Sequence
  luciferase fusion protein
atgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagaggaggtccagcccagagacactgatttcagacctcttgatgagagaaagcacagaaaatgttcccagaactcggcttgaagaccctgcaatgtggtga

SEQ ID NO: 245 - DNA, 1938 bp, Artificial Sequence
  luciferase fusion protein
atggccgtcgcatactgctgcctctccctgtttctcgtatccacttgggtggctctgctgctgcagcccctgcaggggacctggggagcccccctggagccaatgtacccaggcgactatgcgacacctgagcagatggcacaatatgaaactcagctccgcagatacatcaacacactgaccaggcctaggtatgggaagagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagaggagggccgaggaggagaacacaggtggacttcctggagtgcagctctccccctgcaccagccccccagttggcttgattccctgctctgcgccctggagctga

SEQ ID NO: 246 - DNA, 1923 bp, Artificial Sequence
  luciferase fusion protein
atggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtatgggaaaagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagaggaggcacaaagaggacacgctggccttctcggagtgggggtccccgcatgctgctgtccccagggagctcagcccgctggacttataa

SEQ ID NO: 247 - DNA, 1989 bp, Artificial Sequence
  luciferase fusion protein
atgctgtcctgccgtctccagtgcgccctggctgcgctctgcatcgtcctggctttgggcggtgtcaccggcgcgccctcggaccccagactccgtcagtttctgcagaagtctctggcggctgccaccgggaaacaggaactggccaagtacttcttggcagagctgcgcaaatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgcaaactgtccgagcccaaccagacagagaatgatgccctggagcccgaggatttgccccaggcagctgagcaggacgagatgaggctggagctgcagaggtctgccaactcgaacccagcaatggcaccccgggaacgcaaagctggctgcaagaacttcttctggaagacattcacatcctgttag

SEQ ID NO: 248 - DNA, 1989 bp, Artificial Sequence
  luciferase fusion protein
atgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgcgcaaatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgcaaactgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttag

SEQ ID NO: 249 - DNA, 1950 bp, Artificial Sequence
  luciferase fusion protein
atgctgctctgggtgctctttgtgatcctcatcctcaccagtggctcccactgctcactgcccccctcacctcccttcaggatgcagcgacacgtagatgccatcttcaccaccaactacaggaaactcctgagccagctgtatgcccggaaagtgatccaggacatcatgaacaagcaaggggagaggatccaggaacaaagggccaggctcagccgccaggaagacagcatgtggacagaggacaagcagatgaccctggagagcatccggcggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggcggttgcagggattcccaaggatgaagccttcagcggacgcttga

SEQ ID NO: 250 - DNA, 1962 bp, Artificial Sequence
  luciferase fusion protein
atgccactctgggtgttcttctttgtgatcctcaccctcagcaacagctcccactgctccccacctccccctttgaccctcaggatgcggcggtatgcagatgccatcttcaccaacagctaccggaaggtgctgggccagctgtccgcccgcaagctgctccaggacatcatgagcaggcagcagggagagagcaaccaagagcgaggagcaagggcacggcttggtcgtcaggtagacagcatgtgggcagaacaaaagcaaatggaattggagagcatcctggtggccctgcggcggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggcggctgcagaagcacaggaactcccagggatga

SEQ ID NO: 251 - DNA, 2340 bp, Artificial Sequence
  luciferase fusion protein
atgccgagattctgctacagtcgctcaggggccctgttgctggccctcctgcttcagacctccatagatgtgtggagctggtgcctggagagcagccagtgccaggacctcaccacggagagcaacctgctggcttgcatccgggcttgcaaactcgacctctcgctggagacgcccgtgtttcctggcaacggagatgaacagcccctgactgaaaacccccggaagtacgtcatgggtcacttccgctgggaccgcttcggccccaggaacagcagcagtgctggcagcgcggcgcagaggcgtgcggaggaagaggcggtgtggggagatggcagtccagagccgagtccacgcgagggcaagcgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgctcctactccatggagcacttccgctggggcaagccggtgggcaagaaacggcgcccggtgaaggtgtaccccaacgttgctgagaacgagtcggcggaggcctttcccctagagttcaagagggagctggaaggcgagcggccattaggcttggagcaggtcctggagtccgacgcggagaaggacgacgggccctaccgggtggagcacttccgctggagcaacccgcccaaggacaagcgttacggtggcttcatgacctccgagaagagccagacgcccctggtgacgctcttcaagaacgccatcatcaagaacgcgcacaagaagggccagtga

SEQ ID NO: 252 - DNA, 2436 bp, Artificial Sequence
  luciferase fusion protein
atgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtga

SEQ ID NO: 253 - DNA, 2010 bp, Artificial Sequence
  luciferase fusion protein
atggcctgccccagtctcgcttgctgcctgcttggcttactggctctgacctcggcctgctacatccagaactgccccctgggcggcaagaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgcgctgtgctggacctggatatgcgcaagtgtctcccctgcggcccgggcggcaaaggacgctgcttcggaccaagcatctgctgcgcggacgagctgggctgcttcgtgggcaccgccgaggcgctgcgctgccaggaggagaactacctgccttcgccctgccagtctggccagaagccctgcgggagcggaggccgctgcgccgccacaggcatctgctgcagcccggatggctgccgcacagaccccgcctgcgaccctgagtctgccttctcggagcgctga

SEQ ID NO: 254 - DNA, 2010 bp, Artificial Sequence
  luciferase fusion protein
atggccggccccagcctcgcttgctgtctgctcggcctcctggcgctgacctccgcctgctacatccagaactgccccctgggaggcaagaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgcgccgcgccggacctcgacgtgcgcaagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccggacggctgccacgccgaccctgcctgcgacgcggaagccaccttctcccagcgctga

SEQ ID NO: 255 - DNA, 2139 bp, Artificial Sequence
  luciferase fusion protein
atgctcgccaggatgctcaacactacgctctccgcttgtttcctgagcctgctggccttctcctccgcctgctacttccagaactgcccaagaggcggcaagaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgcgccatctctgacatggagctgagacagtgtctcccctgcggcccgggcggcaaaggacgctgcttcggaccaagcatctgctgcgcggacgagctgggctgcttcgtgggcaccgccgaggcgctgcgctgccaggaggagaactacctgccctcgccctgccagtccggccagaagccctgcgggagcgggggccgctgcgccgccgtgggcatctgctgcagcgacgagagctgcgtggccgagcccgagtgccacgacggttttttccgcctcacccgcgctcgggagccaagcaacgccacacagctggacggccctgctcgggcgctgctgctaaggctggtacagctggctgggacacgggagtccgtggattctgccaagccccgggtctactga

SEQ ID NO: 256 - DNA, 2127 bp, Artificial Sequence
  luciferase fusion protein
atgcctgacaccatgctgcccgcctgcttcctcggcctactggccttctcctccgcgtgctacttccagaactgcccgaggggcggcaagaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgcgccatgtccgacctggagctgagacagtgcctcccctgcggccccgggggcaaaggccgctgcttcgggcccagcatctgctgcgcggacgagctgggctgcttcgtgggcacggctgaggcgctgcgctgccaggaggagaactacctgccgtcgccctgccagtccggccagaaggcgtgcgggagcgggggccgctgcgccgccttcggcgtttgctgcaacgacgagagctgcgtgaccgagcccgagtgccgcgagggctttcaccgccgcgcccgcgccagcgaccggagcaacgccacgcagctggacgggccggccggggccttgctgctgcggctggtgcagctggccggggcgcccgagcccttcgagcccgcccagcccgacgcctactga

SEQ ID NO: 257 - DNA, 1905 bp, Artificial Sequence
  luciferase fusion protein
atgatcctcaaactgatggccggcattctactgctgactgtgtgtttggaaggctgctccagccagcactggtcctatgggttgcgccctgggggaaagagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgcaacactgaacacttggttgagtctttccaagagatgggcaaggaggtggatcaaatggcagaaccccagcacttcgaatgtactgtccactggccccgttcacccctcagggatctgcgaggagctctggaaagtctgattgaagaggaagccaggcagaagaagatgtag

SEQ ID NO: 258 - DNA, 1911 bp, Artificial Sequence
  luciferase fusion protein
atgaagccaattcaaaaactcctagctggccttattctactgacttggtgcgtggaaggctgctccagccagcactggtcctatggactgcgccctggaggaaagagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgcgatgccgaaaatttgattgattctttccaagagatagtcaaagaggttggtcaactggcagaaacccaacgcttcgaatgcaccacgcaccagccacgttctcccctccgagacctgaaaggagctctggaaagtctgattgaagaggaaactgggcagaagaagatttaa

SEQ ID NO: 259 - DNA, 2049 bp, Artificial Sequence
  luciferase fusion protein
atgagtgctgccgtcctcctctccgtgctttttgctcttgcttgtgggcaagcagcatccttttgtattcccactgagtatacaatgtacgtggataggagagagtgtgcctactgcctgaccatcaacaccaccatctgtgctgggtattgtatgacacgggatatcaatggcaaactgtttcttcccaaatatgcactctctcaggatgtctgtacatacagagacttcatctacagaacggtggaaataccaggatgcccgcaccatgttactccttatttctccttccctgtcgccataagctgcaagtgtggcaagtgtaatactgacaacagtgactgcatacacgaggctgtcagaaccaactactgcaccaagccgcagtctttctatctgtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaatatctggggggattttctgtttaa

SEQ ID NO: 260 - DNA, 2049 bp, Artificial Sequence
  luciferase fusion protein
atgactgctctctttctgatgtccatgctttttggccttacatgtgggcaagcgatgtctttttgtattccaactgagtatacaatgcacatcgaaaggagagagtgtgcttattgcctaaccatcaacaccaccatctgtgctggatattgtatgacacgggatatcaatggcaaactgtttcttcccaaatatgctctgtcccaggatgtttgcacatatagagacttcatctacaggactgtagaaataccaggatgcccactccatgttgctccctatttttcctatcctgttgctttaagctgtaagtgtggcaagtgcaatactgactatagtgactgcatacatgaagccatcaagacaaactactgtaccaaacctcagaagtcttatctgtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaatatctggtaggattttctgtctaa

SEQ ID NO: 261 - DNA, 2196 bp, Artificial Sequence
  luciferase fusion protein
atgcggctgcggctgctggtgtccgcgggcatgctgctggtggctctgtcgtcctgcctgccttgcagggccctgctcagcaggggatccgtcccccgagcgccgcgggccccgcagcccttgaatttcttgcagccggagcagccccagcaacctcagccggttctgatccgcatgggtgaagaatacttcctccgcctggggaatctcaacagaagtcccgctgctcggctgtcccccaactccacgcccctcaccgcgggtcgcggcagccgcccctcgcacgaccaggctgcggctaactttttccgcgtgttgctgcagcagctgcagatgcctcagcgctcgctcgacagccgcgcggagccggccgaacgcggcgccgaggatgccctcggtggccaccagggggcgctggagagggagaggcggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaggcggtcggaggagccgcccatctctctggatctcaccttccaccttctgcgggaagtcttggaaatggcccgggcagagcagttagctcagcaagctcacagcaacaggaaactgatggagattatcgggaaatga

SEQ ID NO: 262 - DNA, 2223 bp, Artificial Sequence
  luciferase fusion protein
atgcggctgccgctgcttgtgtccgcgggagtcctgctggtggctctcctgccctgcccgccatgcagggcgctcctgagccgcgggccggtcccgggagctcggcaggcgccgcagcaccctcagcccttggatttcttccagccgccgccgcagtccgagcagccccagcagccgcaggctcggccggtcctgctccgcatgggagaggagtacttcctccgcctggggaacctcaacaagagcccggccgctcccctttcgcccgcctcctcgctcctcgccggaggcagcggcagccgcccttcgccggaacaggcgaccgccaactttttccgcgtgttgctgcagcagctgctgctgcctcggcgctcgctcgacagccccgcggctctcgcggagcgcggcgctaggaatgccctcggcggccaccaggaggcaccggagagagaaaggcggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaggcggtccgaggagcctcccatctccctggatctcaccttccacctcctccgggaagtcttggaaatggccagggccgagcagttagcacagcaagctcacagcaacaggaaactcatggagattattgggaaataa

SEQ ID NO: 263 - DNA, 2091 bp, Artificial Sequence
  luciferase fusion protein
atgggctccttctccatcaccctgggcttcttcctcgtcttggccttttggcttccaggccatattggagcaaatcctgtgtacagtgcggtgtccaacacagatctgatggatttcaagaacctgctagaccacctggaggagaagatgccggtagaagatgaggtcatgcccccgcaggccctgagtgagcagactgaggaagcaggggccgcacttagctccctccccgaggtgcctccctggactggggaggtcaacccacctctgagagacggcagtgctctagggcgcagcccctgggacccctccgatagatctgccctcttgaaaagcaaactgagggctctgctcgctggccctcggagctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggagcctacgaagatccagctgcttcgggggtaggattgacaggattggagcccagagtggactaggctgcaacagcttccggtaccgaagataa

SEQ ID NO: 264 - DNA, 2088 bp, Artificial Sequence
  luciferase fusion protein
atgagctccttctccaccaccaccgtgagcttcctccttttactggcattccagctcctaggtcagaccagagctaatcccatgtacaatgccgtgtccaacgcagacctgatggatttcaagaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggagcctgcggagatccagctgcttcgggggcaggatggacaggattggagcccagagcggactgggctgtaacagcttccggtactga

SEQ ID NO: 265 - DNA, 1998 bp, Artificial Sequence
  luciferase fusion protein
atggatctcctgaaggtgctgtcccagatgattctgtttctgcttttcctttatctgtcaccgctgggaggtcactcctatcctctgggaagtcctagccagtctccagagcaattcaagatgcagaagctgctggagctgataagagaaaagtcggaggaaatggcccagagacagctcttgaaggaccaaggcctcacaaaagaacacccaaaaagagtccttcggtcttactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggtctcaaggcagcaccctccgggtccagcagagacctcaaaattccaaggtgacacatatctcaagctgctttgggcacaagatagaccggatcggatccgtcagtcgtttgggctgtaacgcactgaagttgttgtag

SEQ ID NO: 266 - DNA, 2043 bp, Artificial Sequence
  luciferase fusion protein
atggatccccagacagcaccttcccgggcgctcctgctcctgctcttcttgcatctggctttcctgggaggtcgttcccacccgctgggcagccccggttcagcctcggacttggaaacgtccgggttacaggagcagcgcaaccatttgcagggcaaactgtcggagctgcaggtggagcagacatccctggagcccctccaggagagcccccgtcccacaggtgtctggaagtcccgggaggtagccaccgagggcatccgtgggcaccgcaaaatggtcctctacaccctgcgggcaccacgaagctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgaagccgaagccccaagatggtgcaagggtctggctgctttgggaggaagatggaccggatcagctcctccagtggcctgggctgcaaagtgctgaggcggcattaa

SEQ ID NO: 267 - DNA, 2841 bp, Artificial Sequence
  luciferase fusion protein
atggacagaaggaggatgcctctctgggcactcttgttgctctggagtccttgcaccttcagtctcccaacacgcaccgctacctttgaacgaatcccgctcaagaaaatgccttctgtccgggaaatcctggaggagcggggagtggacatgaccaggctcagtgctgaatggggcgtattcacaaagaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagaggccttccttgaccaatcttacctcccccgtggtcctcaccaactacctgaatacccagtactacggcgagattggcatcggtaccccaccccagaccttcaaagtcatctttgacacgggttcagccaacctctgggtgccctccaccaagtgcagccgcctctaccttgcttgtgggattcacagcctctatgagtcctctgactcctccagctacatggagaacgggtccgacttcaccatccactacggatcagggagagtcaaaggtttcctcagccaggactcggtgactgtgggtggaatcactgtgacacagacctttggagaggtcaccgagctgcccctgatccctttcatgctggccaagtttgacggtgttctaggcatgggctttcccgctcaggccgttggcggggttacccctgtctttgaccacattctctcccagggggtgctaaaggaggaagtgttctctgtctactacaacaggggttcccacctgctggggggcgaggtggtgctaggaggtagcgacccgcagcattatcaaggcaattttcactatgtgagcatcagcaagactgactcctggcagatcacgatgaagggggtgtctgtggggtcttccaccctgctatgtgaagaaggctgtgcggtagtggtggacactggttcatcctttatctcggctcctacgagctccctgaagttgatcatgcaagccctgggagccaaggagaagagaatagaagaatatgttgtgaactgtagccaggtgcccaccctccccgacatttcctttgacctgggaggcagggcctacacactcagcagtacggactacgtgctacagtatcccaacaggagagacaagctgtgcacactggctctccatgccatggacatcccaccacccactgggcctgtctgggtcctgggtgccaccttcatccgcaagttctatacagagtttgatcggcataacaatcgcattggattcgccttggcccgctaa

SEQ ID NO: 268 - DNA, 2853 bp, Artificial Sequence
  luciferase fusion protein
atggatggatggagaaggatgcctcgctggggactgctgctgctgctctggggctcctgtacctttggtctcccgacagacaccaccacctttaaacggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaaacggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattggcatcggcaccccaccccagaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacagagattccgagaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctga

SEQ ID NO: 269 - DNA, 2010 bp, Artificial Sequence
  luciferase fusion protein
atggccagaggcagcgttatcctgctaggctggctcctgttggttgtgaccctgtcagccactctgggacttgggatgcctgcaaaggagaagagaggttactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagagaggttggaccctgaacagcgctggctaccttctgggcccacatgccattgacaaccacagatcatttagcgacaagcatggcctcacaggcaagagggagttacaactggaggtggaggaaaggagaccaggaagtgttgatgtgcccctgcctgagagcaacattgtccgcactataatggagtttctcagtttcttgcaccttaaagaggccggggccctcgacagcctgcctggcatccccttggccacctcctcagaagacctagagaagtcctga

SEQ ID NO: 270 - DNA, 2007 bp, Artificial Sequence
  luciferase fusion protein
atggcccgaggcagcgccctcctgctcgcctccctcctcctcgccgcggccctttctgcctctgcggggctctggtcgccggccaaggaaaaacgaggctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctga

SEQ ID NO: 271 - DNA, 2028 bp, Artificial Sequence
  luciferase fusion protein
atgaactttccttctacaaaggttccctgggccgccgtgacgctgctgctgctgctactgctgccgccggcgctgctgtcgcttggggtggacgcacagcctctgcccgactgctgtcgccagaagacgtgttcctgccgtctctacgaactgttgcacggagctggcaaccacgctgcgggtatcctgactctgggaaagcggcggcctggacctccaggcctccagggacggctgcagcgcctccttcaggccaacggtaaccacgcagctggcatcctgaccatgggccgccgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaggccgccgcgcaggcgcagagctagagccacatccctgctctggtcgcggctgtccgaccgtaactaccaccgctttagcaccccggggagggtccggagtctga

SEQ ID NO: 272 - DNA, 2031 bp, Artificial Sequence
  luciferase fusion protein
atgaaccttccttccacaaaggtctcctgggccgccgtgacgctactgctgctgctgctgctgctgccgcccgcgctgttgtcgtccggggcggctgcacagcccctgcccgactgctgtcgtcaaaagacttgctcttgccgcctctacgagctgctgcacggcgcgggcaatcacgcggccggcatcctcacgctgggcaagcggaggtccgggcccccgggcctccagggtcggctgcagcgcctcctgcaggccagcggcaaccacgccgcgggcatcctgaccatgggccgccgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaggccgccgcgcaggcgcagagccagcgccgcgcccctgcctcgggcgccgctgttccgccccggccgccgcctccgtcgcgcccggaggacagtccgggatctga

SEQ ID NO: 273 - DNA, 1989 bp, Artificial Sequence
  luciferase fusion protein
atgctgtcttcaggcaccatctgcagtttgctgctactcagcatgctctggatggacatggccatggcaggctccagcttcctgagcccagagcaccagaaagcccagcagagaaaggaatccaagaagccaccagctaaactgcagccacgagcttactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaccacgagctctggaaggctggctccacccagaggacagaggacaagcagaagagacagaggaggagctggagatcaggttcaatgctcccttcgatgttggcatcaagctgtcaggagctcagtatcagcagcatggccgggccctggggaagtttcttcaggatatcctctgggaagaggtcaaagaggcgccagctgacaagtaa

SEQ ID NO: 274 - DNA, 1986 bp, Artificial Sequence
  luciferase fusion protein
atgccctccccagggaccgtctgcagcctcctgctcctcggcatgctctggctggacttggccatggcaggctccagcttcctgagccctgaacaccagagagtccagagaaaggagtcgaagaagccaccagccaagctgcagccccgagcttactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtga

SEQ ID NO: 275 - DNA, 1992 bp, Artificial Sequence
  luciferase fusion protein
atgaagagcggcgtatgtctgtgcgtggtgatggcagtcctagctgctggcgccctggcgcagccggtagtccctgcagaagctacggaccccgtggagcagcgggcgcaagaggcgccccgaaggcagctgcgggcttactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgaaggcagctgcgggctgtgctccggacggacggcgagccccgagcgcgcctgggcgcactgctagcgcgatacatccagcaggtccgcaaagctccttctggccgcatgtccgttcttaagaacctgcagagcctggaccccagccatagaataagtgaccgggactacatgggctggatggattttggccggcgcagtgccgaggactacgaatacccatcgtag

SEQ ID NO: 276 - DNA, 1992 bp, Artificial Sequence
  luciferase fusion protein
atgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctag

SEQ ID NO: 277 - DNA, 1941 bp, Artificial Sequence
  luciferase fusion protein
atgcctcgactgtgtgtgtacatgctggtcttagtgctggctctagctaccttctcggaagcttcttggaagccccgctcccagctacaggatgcatcatctggaccagggaccaatgaggacctggaacagcgccagttcaacaagctgggctcagcctctcaccatcgaaggcagctggggccccagggtcctcaacacttcatagcagacctgtccaagaagcagaggccacgaatggaggaagaagaagaggcctacggatggatggactttggccgccgcagttactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgccgcagtgctgaggaagaccagtag

SEQ ID NO: 278 - DNA, 1941 bp, Artificial Sequence
  luciferase fusion protein
atgcagcgactatgtgtgtatgtgctgatctttgcactggctctggccgccttctctgaagcttcttggaagccccgctcccagcagccagatgcacccttaggtacaggggccaacagggacctggagctaccctggctggagcagcagggcccagcctctcatcatcgaaggcagctgggaccccagggtcccccacacctcgtggcagacccgtccaagaagcagggaccatggctggaggaagaagaagaagcctatggatggatggacttcggccgccgcagttactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgccgcagtgctgaggatgagaactaa

SEQ ID NO: 279 - DNA, 2025 bp, Artificial Sequence
  luciferase fusion protein
atgaaaatcctcgtggccgtggcggtcttttttctcgtttccactcaactgtttgcagaggaaatcgatgccaacgatgatctaaattattggtccgactggtccgacagtgaccagatcaaggaggcaatgccggagccctttgagcatcttctgcagagaatcgcccgaagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgaagacccaagcctcagcagttctttggattaatgggcaagcgggatgctgattcctcagttgaaaaacaagtggccctgttaaaggctctttatggacatggccagatctctcacaaaaggcataaaacagattcctttgttggactaatgggcaaaagagctttaaattctgtggcttatgaaagaagcgcgatgcagaactacgaaagaagacgtaaataa

SEQ ID NO: 280 - DNA, 2022 bp, Artificial Sequence
  luciferase fusion protein
atgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaa

SEQ ID NO: 281 - DNA, 2439 bp, Artificial Sequence
  luciferase fusion protein
atggcgcggttcctgaggctttgcacctggctgctggcgcttgggtcctgcctcctggctacagtgcaggcggaatgcagccaggactgcgctaaatgcagctaccgcctggttcgcccaggcgacatcaatttcctggcgtgcacactggaatgtgaaggacagctgccttctttcaaaatctgggagacctgcaaggatctcctgcaggtgtccaggcccgagttcccttgggataacatcgacatgtacaaagacagcagcaaacaggatgagagccacttgctagccaagaagtacggaggcttcatgaaacggtacggaggcttcatgaagaagatggacgagctatatcccatggagccagaagaagaagcgaacggaggagagatccttgccaagaggtatggcggcttcatgaagaaggatgcagatgagggagacaccttggccaactcctccgatctgctgaaagagctactgggaacgggagacaaccgtgcgaaagacagccaccaacaagagagcaccaacaatgacgaagacatgagcaagaggtatgggggcttcatgagaagcctcaaaagaagcccccaactggaagatgaagcaaaagagctgcagaagcgctacgggggcttcatgagaaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaagaagggtgggacgccccgagtggtggatggactaccagaagaggtatgggggcttcctgaagcgctttgctgagtctctgccctccgatgaagaaggcgaaaattactcgaaagaagttcctgagatagagaaaagatacgggggctttatgcggttctga

SEQ ID NO: 282 - DNA, 2436 bp, Artificial Sequence
  luciferase fusion protein
atggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaa

SEQ ID NO: 283 - DNA, 2379 bp, Artificial Sequence
  luciferase fusion protein
atggcgtggtccaggctgatgctggcagcttgcctcctcgtgatgccctctaatgttatggcggactgcctgtccctgtgctccctgtgtgcagtgaggattcaggatgggccccgtcccatcaaccccctgatttgctccctggagtgccaggacctggtgccgccctcagaggagtgggagacatgccggggcttctcatcttttctcaccctgacggtctctgggctccgtggcaaggatgacttggaagatgaggttgctttggaagaaggctacagtgcactagccaagctcttggaacccgtcctgaaggagctggagaaaagccgactccttaccagcgtcccagaggaaaagttcaggggtctctccagcagctttggcaacggaaaagaatctgagctggcgggtgctgaccggatgaatgatgaagccgcacaggcgggcacgctccattttaatgaggaggacttgagaaaacaggccaaacgctatggcggctttttgcgcaaataccccaagaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagaggagttccgagatggcccgggatgaggacgggggccaggatggggatcaggtagggcatgaggacctgtacaaacgctatgggggcttcctgcggcgcattcgccccaagctgaagtgggacaaccagaagcgctatggtggtttcctgcggcgtcagttcaaggtggtgacgcggtcccaggagaaccccaatacctattctgaagatttagatgtttga

SEQ ID NO: 284 - DNA, 2397 bp, Artificial Sequence
  luciferase fusion protein
atggcctggcaggggctggtcctggctgcctgcctcctcatgttcccctccaccacagcggactgcctgtcgcggtgctccttgtgtgctgtaaagacccaggatggtcccaaacctatcaatcccctgatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataa

SEQ ID NO: 285 - DNA, 2121 bp, Artificial Sequence
  luciferase fusion protein
atggggaaaatcagcagccttccaactcaattatttaagatctgcctctgtgacttcttgaagataaagatacacatcatgtcgtcttcacacctcttctacctggcgctctgcttgctcaccttcaccagctccaccacagctggaccagagaccctttgcggggctgagctggtggatgctcttcagttcgtgtgtggaccgaggggcttttacttcaacaagcccacaggctatggctccagcattcggaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaatccagcattcggagggcacctcagacaggcattgtggatgagtgttgcttccggagctgtgatctgaggagactggagatgtactgtgccccactgaagcctacaaaagcagcccgctctatccgtgcccagcgccacactgacatgcccaagactcagaagtccccgtccctatcgacaaacaagaaaacgaagctgcaaaggagaaggaaaggaagtacatttgaagaacacaagtag

SEQ ID NO: 286 - DNA, 2115 bp, Artificial Sequence
  luciferase fusion protein
atgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtag

SEQ ID NO: 287 - DNA, 2211 bp, Artificial Sequence
  luciferase fusion protein
atgggcggcagcgtcgccggcttccaggtaccaatggggatcccagtggggaagtcgatgttggtgcttctcatctctttggccttcgccttgtgctgcatcgctgcttacggccccggagagactctgtgcggaggggagcttgttgacacgcttcagtttgtctgttcggaccgcggcttctacttcagcaggccttcaagccgtgccaaccgtcgcagccgtggcatcgtggaagagtgctgcttccgcagctgcgacctggccctcctggagacatactgtgccacccccgccaagtccgagagggactactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaagagagggacgtgtctacctctcaggccgtacttccggacgacttccccagataccccgtgggcaagttcttccaatatgacacctggagacagtccgcgggacgcctgcgcagaggcctgcctgccctcctgcgtgcccgccggggtcgcatgcttgccaaagagctcaaagagttcagagaggccaaacgtcatcgtcccctgatcgtgttaccacccaaagaccccgcccacgggggagcctcttcggagatgtccagcaaccatcagtga

SEQ ID NO: 288 - DNA, 2178 bp, Artificial Sequence
  luciferase fusion protein
atgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggactactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaagagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtga

SEQ ID NO: 289 - DNA, 1980 bp, Artificial Sequence
  luciferase fusion protein
atgatgtctgcaaacaccgtggctaaagtgatgatcatcatgctggcagtctgtcttcttacccaaacggatgggaaacccgtgaggaagagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagagagctgtcagtgaaatacagcttatgcacaacctgggcaaacacctggcctccatggagaggatgcaatggctgagaaggaagctgcaagatatgcacaattttgttagtcttggagtccaaatggctgccagagatggcagtcaccagaagcccaccaagaaggaggaaaatgtccttgttgatggcaatccaaaaagtcttggtgagggagacaaagctgatgtggatgtattagttaaatcaaaatctcagtaa

SEQ ID NO: 290 - DNA, 1980 bp, Artificial Sequence
  luciferase fusion protein
atgatacctgcaaaagacatggctaaagttatgattgtcatgttggcaatttgttttcttacaaaatcggatgggaaatctgttaagaagagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttcccagaggccccgaaaaaaggaagacaatgtcttggttgagagccatgaaaaaagtcttggagaggcagacaaagctgatgtgaatgtattaactaaagctaaatcccagtga

SEQ ID NO: 291 - DNA, 2160 bp, Artificial Sequence
  luciferase fusion protein
atgctgcggaggctggttcagcagtggagtgtcctggtattcctgctcagctactccgtgccctcccgcgggcgttcggtggaggggcttggccgcaggctcaaacgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaaacgcgctgtgtctgaacatcagctactgcatgacaagggcaagtccatccaagacttgcgccgccgtttcttcctccaccatctgatcgcggagatccacacagccgaaatcagagctacctcggaggtgtcccccaactccaaacctgctcccaacaccaaaaaccaccccgtgcggtttgggtcagacgatgagggcagatacctaactcaggaaaccaacaaggtggagacgtacaaagaacagccactcaagacacccgggaagaagaagaaaggcaagcctgggaaacgcagagaacaggagaaaaagaagcgaaggactcggtctgcctggccaagcacagctgcgagtggcctgcttgaggaccccctgccccacacctccaggccctcgctggagcccagcttaaggacgcattga

SEQ ID NO: 292 - DNA, 2166 bp, Artificial Sequence
  luciferase fusion protein
atgcagcggagactggttcagcagtggagcgtcgcggtgttcctgctgagctacgcggtgccctcctgcgggcgctcggtggagggtctcagccgccgcctcaaaagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattga

SEQ ID NO: 293 - DNA, 1920 bp, Artificial Sequence
  luciferase fusion protein
atgaggaccatctttctgctcactctgctgaccctggctgcgctctgtctctctgacctcacagatgccaagcccagcggccctgagtctgacaaagccttcatgtccaagcaggagggcaataaggtagtgaacagactccggcgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggcgctaccttggagcctcagtccccagcccagatcccctggagcccacccgggagcagtgtgagcttaaccctgcttgtgacgagctatcagaccagtatggcttgaagaccgcctacaaacgcatctatggtatcactatttag

SEQ ID NO: 294 - DNA, 1935 bp, Artificial Sequence
  luciferase fusion protein
atgagagccctcacactcctcgccctattggccctggccgcactttgcatcgctggccaggcaggtgcgaagcccagcggtgcagagtccagcaaaggtgcagcctttgtgtccaagcaggagggcagcgaggtagtgaagagacccaggcgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctag

SEQ ID NO: 295 - DNA, 2133 bp, Artificial Sequence
  luciferase fusion protein
atgctgatgcccacctacttcctgctgccacttctgctgctcctaggaggtccaaggacaagcctctcccacaagttctacaacactggaccagtcttcagctgcctcaacacagccctatctgaggtcaagaagaacaagctggaagatgtgcccttgctgagcaagaagagctttggccacctgcccacacaagacccctcaggggaagaagatgacaaccaaacgcacctccagatcaaaagaactttctcaggtgccgcgggtgggaatggagctgggagcacccggtacagataccaatcccaggcacagcacaaggggaagctgtacccagacaagcccaaaagcgaccggggcaccaagtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggggcaccaagttcaccctttcccttgatgttcccactaacatcatgaacatcctcttcaacatcgacaaggccaagaatttgcgagccaaggcagctgccaatgctcagctcatggcacagattgggaagaagaagtaa

SEQ ID NO: 296 - DNA, 2118 bp, Artificial Sequence
  luciferase fusion protein
atgctgatgccggtccacttcctgctgctcctgctgctgctcctggggggccccaggacaggcctcccccacaagttctacaaagccaagcccatcttcagctgcctcaacaccgccctgtctgaggctgagaagggccagtgggaggatgcatccctgctgagcaagaggagcttccactacctgcgcagcagagacgcctcttcgggagaggaggaggagggcaaagagaaaaagactttccccatctctggggccaggggtggagccagaggcacccggtacagatacgtgtcccaagcacagcccaggggaaagccacgccaggacacggccaagagtccccaccgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacaccgcaccaagttcaccctgtccctcgacgtccccaccaacatcatgaacctcctcttcaacatcgccaaggccaagaacctgcgtgcccaggcggccgccaatgcccacctgatggcgcaaattgggaggaagaagtag

SEQ ID NO: 297 - DNA, 1977 bp, Artificial Sequence
  luciferase fusion protein
atgatgaccaggtgggcactggtggtgttcgtggtcctgatgttggataggatcctatttgtcccaggaactcctatccccaccttccagctcctccctcagaactctctggagacaactcctagctctgtgacctcagagagctcctcaggtaccaccacaggaccctcagcttcctggagcaactctaaagccagcccttacctagacacccgtgtctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaacccgtgtcatactctccctggatgttcccattggcctcctacggatcttactggaacaggctcgttacaaggctgccaggaatcaggctgccactaatgctcaaatactagcccatgttggccgccgctga

SEQ ID NO: 298 - DNA, 1974 bp, Artificial Sequence
  luciferase fusion protein
atgaccaggtgtgctctgctgttgctgatggtcctgatgttgggcagagtcctggttgtcccagtgacccctatcccaaccttccagctccgccctcagaattctccccagaccactccccgacctgcggcctcagagagcccctcagctgctcccacatggccgtgggctgcccagagccactgcagccccacccgccaccctggctcgcgcatttactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaatcgcgcattgtcctatcgctggatgtccccatcggcctcttgcagatcttactggagcaagcccgggccagggctgccagggagcaggccaccaccaacgcccgcatcctggcccgtgtcggccactgctga

SEQ ID NO: 299 - DNA, 2001 bp, Artificial Sequence
  luciferase fusion protein
atgatacagaggggacgcgctacgctcctggtggcgttgctgctcttggcacagcttcgcccggagagcagccagtggagcccagcggctgcggcggcaactggggtccaggatccgaatctgcgatggagccctggagtgcggaatcagggcggcggcgtccgcgcgctcctcttgctgttagcggagcgcttcccgcgccgcgcaggatctgagcctgcgggcgagcggcagcgacggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgacgggacgaccctccactgtccatcgacctcaccttccacctgctgcggaccctgctggagctagctcggacacagagccagcgcgagcgcgcagagcagaaccgcatcatattcgattcggtgggcaagtga

SEQ ID NO: 300 - DNA, 2007 bp, Artificial Sequence
  luciferase fusion protein
atgaggcaggcgggacgcgcagcgctgctggccgcgctgctgctcctggtacagctgtgccctgggagcagccagaggagccccgaggcggccggggtccaggacccgagtctgcgctggagccccggggcacggaaccagggtggcggggcccgcgcgctcctcttgctgctggcggagcgcttcccgcgccgcgcggggcccggccgattgggactcgggacggcaggcgagcggccgcggcggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggcgggacaacccttctctgtccattgacctcacctttcacctgctgcggaccctgctggagctggcgcggacgcagagccagcgggagcgcgccgagcagaaccgcatcatattcgactcggtgggcaagtga

SEQ ID NO: 301 - DNA, 2388 bp, Artificial Sequence
  luciferase fusion protein
atgctagggacctgccttagactcctggtgggcgtgctctgcactgtctgcagcttgggcactgctagagcctatccggacacttccccattgcttggctccaactggggaagcctgacccacctgtacacggctacagccaggaccagctatcacctacagatccatagggatggtcatgtagatggcaccccccatcagaccatctacagtgccctgatgattacatcagaggacgccggctctgtggtgataacaggagccatgactcgaaggttcctttgtatggatctccacggcaacatttttggatcgcttcacttcagcccagagaattgcaagttccgccagtggacgctggagaatggctatgacgtctacttgtcgcagaagcatcactacctggtgagcctgggccgcgccaagcgcatcttccagccgggcaccaacccgccgcccttctcccagttcctggctcgcaggaacgaggtcccgctgctgcatttctacactgttcgcccacggcgccacacgcgcagctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgcagcgccgaggacccaccggagcgcgacccactgaacgtgctcaagccgcggccccgcgccacgcctgtgcctgtatcctgctctcgcgagctgccgagcgcagaggaaggtggccccgcagccagcgatcctctgggggtgctgcgcagaggccgtggagatgctcgcgggggcgcgggaggcgcggataggtgtcgcccctttcccaggttcgtctag

SEQ ID NO: 302 - DNA, 2388 bp, Artificial Sequence
  luciferase fusion protein
atgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgccctgatgatcagatcagaggatgctggctttgtggtgattacaggtgtgatgagcagaagatacctctgcatggatttcagaggcaacatttttggatcacactatttcgacccggagaactgcaggttccaacaccagacgctggaaaacgggtacgacgtctaccactctcctcagtatcacttcctggtcagtctgggccgggcgaagagagccttcctgccaggcatgaacccacccccgtactcccagttcctgtcccggaggaacgagatccccctaattcacttcaacacccccataccacggcggcacacccggagctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggagcgccgaggacgactcggagcgggaccccctgaacgtgctgaagccccgggcccggatgaccccggccccggcctcctgttcacaggagctcccgagcgccgaggacaacagcccgatggccagtgacccattaggggtggtcaggggcggtcgagtgaacacgcacgctgggggaacgggcccggaaggctgccgccccttcgccaagttcatctag

SEQ ID NO: 303 - DNA, 2460 bp, Artificial Sequence
  luciferase fusion protein
atggcaactgttcctgaactcaactgtgaaatgccaccttttgacagtgatgagaatgacctgttctttgaagttgacggaccccaaaagatgaagggctgcttccaaacctttgacctgggctgtcctgatgagagcatccagcttcaaatctcgcagcagcacatcaacaagagcttcaggcaggcagtatcactcattgtggctgtggagaagctgtggcagctacctgtgtctttcccgtggaccttccaggatgaggacatgagcaccttcttttccttcatctttgaagaagagcccatcctctgtgactcatgggatgatgatgataacctgctggtgtgtgacgttccctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaactggtgtgtgacgttcccgttcccattagacaactgcactacaggctccgagatgaacaacaaaaaagcctcgtgctgtcggacccatatgagctgaaagctctccacctcaatggacagaatatcaaccaacaagtgatattctccatgagctttgtacaaggagaaccaagcaacgacaaaatacctgtggccttgggcctcaaaggaaagaatctatacctgtcctgtgtaatgaaagacggcacacccaccctgcagctggagagtgtggatcccaagcaatacccaaagaagaagatggaaaaacggtttgtcttcaacaagatagaagtcaagagcaaagtggagtttgagtctgcagagttccccaactggtacatcagcacctcacaagcagagcacaagcctgtcttcctgggaaacaacagtggtcaggacataattgacttcaccatggaatccgtgtcttcctaa

SEQ ID NO: 304 - DNA, 2454 bp, Artificial Sequence
  luciferase fusion protein
atggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcaccttactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaatatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaa

SEQ ID NO: 305 - DNA, 2340 bp, Artificial Sequence
  luciferase fusion protein
atgagcacagaaagcatgatccgcgacgtggaactggcagaagaggcactcccccaaaagatggggggcttccagaactccaggcggtgcctatgtctcagcctcttctcattcctgcttgtggcaggggccaccacgctcttctgtctactgaacttcggggtgatcggtccccaaagggatgagaagttcccaaatggcctccctctcatcagttctatggcccagaccctcacactcagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaactcagatcatcttctcaaaattcgagtgacaagcctgtagcccacgtcgtagcaaaccaccaagtggaggagcagctggagtggctgagccagcgcgccaacgccctcctggccaacggcatggatctcaaagacaaccaactagtggtgccagccgatgggttgtaccttgtctactcccaggttctcttcaagggacaaggctgccccgactacgtgctcctcacccacaccgtcagccgatttgctatctcataccaggagaaagtcaacctcctctctgccgtcaagagcccctgccccaaggacacccctgagggggctgagctcaaaccctggtatgagcccatatacctgggaggagtcttccagctggagaagggggaccaactcagcgctgaggtcaatctgcccaagtacttagactttgcggagtccgggcaggtctactttggagtcattgctctgtga

SEQ ID NO: 306 - DNA, 2334 bp, Artificial Sequence
  luciferase fusion protein
atgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtga

SEQ ID NO: 307 - DNA, 2094 bp, Artificial Sequence
  luciferase fusion protein
atgaacgctacacactgcatcttggctttgcagctcttcctcatggctgtttctggctgttactgccacggcacagtcattgaaagcctagaaagtctgaataactattttaactcaagtggcatagatgtggaagaaaagagtctcttcttggatatctggaggaactggcaaaaggatggtgacatgaaaatcctgcagagccagattatctctttctacctcagactctttgaagtcttgaaagacaatcaggccatcagcaacaacataagcgtcattgaatcacacctgattactaccttcttcagcaacagcaaggcgaaaaaggatgcattcatgagtattgccaagtttgaggtcaacaacccacaggtccagcgccaagcattcaatgagctcatccgagtggtccaccagctgttgccggaatccagcctcaggaagtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggaaaaggagtcgctgctga

SEQ ID NO: 308 - DNA, 2136 bp, Artificial Sequence
  luciferase fusion protein
atgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaggtcgaagagcatcccagtaa

SEQ ID NO: 309 - DNA, 4209 bp, Artificial Sequence
  luciferase fusion protein
atggagcggccccggggagctgcggacggccttttgcgctggcccctcggcctcctcctgctccttcaactgctgcctcctgccgccgtcggccaggaccggctggacgcgccgccgccgcccgcgcctcctctgctgcgctgggccggtccggtcggggtgagctgggggctgcgcgccgccgcgcccgggggccccgtcccccgcgctggccgttggcgccgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgccgcggcgcgcccgccgaggaccaagactgcggccgcctcccggacttcatcgccaagctgaccaacaatacgcaccagcatgtctttgatgacctcagtggctcagtgtccttgtcctgggttggagacagcactggggttattctcgtcctgaccactttccaagtgcctctggtaattgtgagctttggacagtccaagttgtatcgaagtgaggattatggaaagaactttaaggatattacaaatctcatcaataacaccttcattcggacggaatttggcatggctattggtcctgagaactctggaaaggtgatactaacagcggaggtgtccgggggaagccgaggcggaagagtgttcaggtcatcagactttgccaagaactttgtgcaaacagatctcccctttcatcctctgacgcagatgatgtacagccctcagaattctgattacctgttagctctcagcaccgaaaatggcctgtgggtgtccaagaattttggggaaaaatgggaagaaatccacaaagcagtatgtttggccaaatggggaccaaacaacatcatcttctttaccacccatgtgaatggctcctgcaaagctgatcttggtgccctggaattatggagaacatccgacttgggaaaaaccttcaaaaccattggtgtgaaaatctactcctttggtcttgggggccgtttcctttttgcctctgtgatggctgataaggacacaacaagaaggatccatgtgtcaacagaccagggggacacatggagcatggcacaacttccttctgtgggacaggaacagttctactccatcctggcagccaatgaggacatggtcttcatgcatgtagatgaacctggagataccgggtttggcaccatctttacctctgatgatcgaggcattgtctactccaagtctctggacagacatctctataccaccacaggcggggagacggactttaccaacgtgacttccctccgtggggtctatataacaagcacgctctcagaagataactctattcagagcatgatcacttttgaccagggaggacggtgggagcacctgcggaagccggagaacagcaagtgcgacgctaccgcaaagaacaagaacgagtgcagccttcatatccatgcttcttatagcatctcccagaagctaaacgttccaatggccccactttccgagcccaatgctgtgggcatagtcatcgctcacggtagtgtgggagatgccatctcggtgatggtcccagatgtgtacatctcagatgatgggggttactcctgggcgaagatgctagaaggaccacattactataccatcctggactctggaggcatcattgtggccattgagcacagcaaccgtcctatcaatgtgattaagttctccacagatgaaggccagtgctggcagagctatgtgttcacacaggagcccatctacttcactgggcttgcttccgagcctggagccaggtccatgaacatcagcatctggggattcacagagtctttcattacccgccagtgggtctcctacacagtcgatttcaaagacatccttgagcggaattgtgaagaggatgactataccacgtggctggcacactccacagaccctggagattacaaagacggctgcattttgggctataaagaacagttcctacggctacggaagtcatccgtctgtcagaatggtcgagactatgttgtggccaagcagccatccgtctgtccgtgttccctggaggacttcctctgtgactttggctacttccgtccggagaacgcctcagagtgcgtggagcagcctgaactgaaggggcatgagttagagttctgtctgtacggcaaggaggagcacctgacaacaaatgggtaccggaaaatcccaggagacaaatgccaaggtgggatgaatcccgccagagaagtaaaagacttgaaaaagaaatgcacaagcaacttcttgaaccccacaaagcaggactcccgcccacagggacacagcttgtcccagaatccagctccgcctcctcttggatacactgaaaacacacacttcctatctcctacccagaagcagaattccaagtcaaattctgtccctattatcctggccatcgtgggactgatgcttgtcacagtcgtagcaggagtcctcattgtgaagaaatatgtctgtggcggaaggttcctggtgcaccggtactcggtgctacagcagcacgcagaggctgacggcgtagaggctttggattcaacctcccacgctaaaagcggatatcacgacgactcagatgaggacctcctggaatag

SEQ ID NO: 310 - DNA, 4128 bp, Artificial Sequence
  luciferase fusion protein
atggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatctttagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggatacaacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatag

SEQ ID NO: 311 - DNA, 2163 bp, Artificial Sequence
  luciferase fusion protein
ctggcgtctaacagagaagtgcggggccctgggcccgggactcccaggaaccggcccctgctgcccctgctgctgcttctgctcttgctaccgctgcccgccagcgcctggtataagcacgtggcgagtccccgctatcacacagtgggtcgtgcctccgggctgctcatggggctgcgccgctcgccctaccagtggcgccgttactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgccgtgccctgggcggggctgctggacccctctcccggctcccaggaccggtcgcccgcggcgctctcctgcttccttcctcagggcaggagctgtgggaggtacgaagcaggagctcacctgcagggcttcccgtccatgcaccctggagtccgcgggacctggagggagtccgccaaccggagcagtcgctaagccttcactcctggatctcagaggagcccgctgctagagccttcggagagacgcttcgtgcccagccatggttcctgcagcaagtcatctttgccgatcctgtcaggcccaagaaccgatggcgcccccatgcttga

SEQ ID NO: 312 - DNA, 2130 bp, Artificial Sequence
  luciferase fusion protein
ctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgccgcgcgctgcgcgcggccgccgggcccctggccagggacaccctctcccccgaacccgcagcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccagagacttcggagagacgtctcccgcccagcggtggaccccgcagcaaaccgccttggcctgccctgcctggcccccggaccgttctga

SEQ ID NO: 313 - DNA, 1983 bp, Artificial Sequence
  luciferase fusion protein
atggagagctcccgcctgcggctgctacccctcctgggcgccgccctgctgctactgctacctttgctgggtgcccgtgcccaggaggacgccgagctgcagccccgagccctggacatctactctgccgtggatgatgcgtcccacgagaaggagctgatcgaagcgttgcaagaagtcctgaagaagctcaagagtaaacgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaaacgcattccgatctacgagaagaagtacggccaagtccccatgtgtgacgctggagagcagtgcgcagtgaggaaaggggccaggatcgggaagctgtgtgactgtccccgaggaacttcctgcaattctttcctcttgaagtgcttgtga

SEQ ID NO: 314 - DNA, 1983 bp, Artificial Sequence
  luciferase fusion protein
atggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctgatcgaagcgctgcaagaagtcttgaagaagctcaagagtaaacgttactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaaacgtgttcccatctatgagaagaagtatggccaagtccccatgtgtgacgccggtgagcagtgtgcagtgaggaaaggggcaaggatcgggaagctgtgtgactgtccccgaggaacctcctgcaattccttcctcctgaagtgcttatga

SEQ ID NO: 315 - DNA, 2805 bp, Artificial Sequence
  luciferase fusion protein
atgccgccctcggggctgcggctactgccgcttctgctcccactcccgtggcttctagtgctgacgcccgggaggccagccgcgggactctccacctgcaagaccatcgacatggagctggtgaaacggaagcgcatcgaagccatccgtggccagatcctgtccaaactaaggctcgccagtcccccaagccagggggaggtaccgcccggcccgctgcccgaggcggtgctcgctttgtacaacagcacccgcgaccgggtggcaggcgagagcgccgacccagagccggagcccgaagcggactactatgctaaagaggtcacccgcgtgctaatggtggaccgcaacaacgccatctatgagaaaaccaaagacatctcacacagtatatatatgttcttcaatacgtcagacattcgggaagcagtgcccgaacccccattgctgtcccgtgcagagctgcgcttgcagagattaaaatcaagtgtggagcaacatgtggaactctaccagaaatatagcaacaattcctggcgttaccttggtaaccggctgctgacccccactgatacgcctgagtggctgtcttttgacgtcactggagttgtacggcagtggctgaaccaaggagacggaatacagggctttcgattcagcgctcactgctcttgtgacagcaaagataacaaactccacgtggaaatcaacgggatcagccccaaacgtcggggcgacctgggcaccatccatgacatgaaccggcccttcctgctcctcatggccacccccctggaaagggcccagcacctgcacagctcacggcaccggagatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggagagccctggataccaactattgcttcagctccacagagaagaactgctgtgtgcggcagctgtacattgactttaggaaggacctgggttggaagtggatccacgagcccaagggctaccatgccaacttctgtctgggaccctgcccctatatttggagcctggacacacagtacagcaaggtccttgccctctacaaccaacacaacccgggcgcttcggcgtcaccgtgctgcgtgccgcaggctttggagccactgcccatcgtctactacgtgggtcgcaagcccaaggtggagcagttgtccaacatgattgtgcgctcctgcaagtgcagctga

SEQ ID NO: 316 - DNA, 2805 bp, Artificial Sequence
  luciferase fusion protein
atgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctga

SEQ ID NO: 317 - DNA, 2877 bp, Artificial Sequence
  luciferase fusion protein
atgcactactgtgtgctgagcacctttttgctcctgcatctggtcccggtggcgctcagtctgtctacctgcagcaccctcgacatggatcagtttatgcgcaagaggatcgaggccatccgcgggcagatcctgagcaagctgaagctcaccagccccccggaagactatccggagccggatgaggtccccccggaggtgatttccatctacaacagtaccagggacttactgcaggagaaggcaagccggagggcagccgcctgcgagcgcgagcggagcgacgaggagtactacgccaaggaggtttataaaatcgacatgccgtcccacctcccctccgaaaatgccatcccgcccactttctacagaccctacttcagaatcgtccgctttgatgtctcaacaatggagaaaaatgcttcgaatctggtgaaggcagagttcagggtcttccgcttgcaaaaccccaaagccagagtggccgagcagcggattgaactgtatcagatccttaaatccaaagacttaacatctcccacccagcgctacatcgatagcaaggttgtgaaaaccagagcggagggtgaatggctctccttcgacgtgacagacgctgtgcaggagtggcttcaccacaaagacaggaacctggggtttaaaataagtttacactgcccctgctgtaccttcgtgccgtctaataattacatcatcccgaataaaagcgaagagctcgaggcgagatttgcaggtattgatggcacctctacatatgccagtggtgatcagaaaactataaagtccactaggaaaaaaaccagtgggaagaccccacatctcctgctaatgttgttgccctcctacagactggagtcacaacagtccagccggcggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggcggaagaagcgcgctttggatgctgcctactgctttagaaatgtgcaggataattgctgccttcgccctctttacattgattttaagagggatcttggatggaaatggatccatgaacccaaagggtacaatgctaacttctgtgctggggcatgcccatatctatggagttcagacactcaacacaccaaagtcctcagcctgtacaacaccataaatcccgaagcttccgcttccccttgctgtgtgtcccaggatctggaaccactgaccattctctattacattggaaatacgcccaagatcgaacagctttccaatatgattgtcaagtcttgtaaatgcagctaa

SEQ ID NO: 318 - DNA, 2961 bp, Artificial Sequence
  luciferase fusion protein
atgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaa

SEQ ID NO: 319 - DNA, 2871 bp, Artificial Sequence
  luciferase fusion protein
atgaagatgcacttgcaaagggctctggtagtcctggccctgctgaacttggccacaatcagcctctctctgtccacttgcaccacgttggacttcggccacatcaagaagaagagggtggaagccattaggggacagatcttgagcaagctcaggctcaccagcccccctgagccatcggtgatgacccacgtcccctatcaggtcctggcactttacaacagcacccgggagttgctggaagagatgcacggggagagggaggaaggctgcactcaggagacctcggagtctgagtactatgccaaagagatccataaattcgacatgatccagggactggcggagcacaatgaactggccgtctgccccaaaggaattacctctaaggtttttcgtttcaatgtgtcctcagtggagaaaaatggaaccaatctgttccgggcagagttccgggtcttgcgggtgcccaaccccagctccaagcgcacagagcagagaattgagctcttccagatacttcgaccggatgagcacatagccaagcagcgctacataggtggcaagaatctgcccacaaggggcaccgctgaatggctgtctttcgatgtcactgacactgtgcgcgagtggctgttgaggagagagtccaacttgggtctggaaatcagcatccactgtccatgtcacacctttcagcccaatggagacatactggaaaatgttcatgaggtgatggaaatcaaattcaaaggagtggacaatgaagatgaccatggccgtggagacctggggcgtctcaagaagcaaaaggatcaccacaacccacacctgatcctcatgatgatccccccacaccgactggacagcccaggccagggcagtcagaggaagtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaggaagaagagggccctggacaccaattactgcttccgcaacctggaggagaactgctgtgtacgccccctttatattgacttccggcaggatctaggctggaaatgggtccacgaacctaagggttactatgccaacttctgctcaggcccttgcccatacctccgcagcgcagacacaacccatagcacggtgcttggactatacaacaccctgaacccagaggcgtctgcctcgccatgctgcgtcccccaggacctggagcccctgaccatcttgtactatgtgggcagaacccccaaggtggagcagctgtccaacatggtggtgaagtcgtgtaagtgcagctga

SEQ ID NO: 320 - DNA, 2871 bp, Artificial Sequence
  luciferase fusion protein
atgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctga

SEQ ID NO: 321 - DNA, 2223 bp, Artificial Sequence
  luciferase fusion protein
atgaggacctgggcttgcctgctgctcctcggctgcggatacctcgcccatgccctggccgaggaagccgagataccccgggagttgatcgagcggctggctcgaagtcagatccacagcatccgggacctccagcgactcttggagatagactccgtaggggctgaggatgccttggagacaagtctgagagcccatgggtcccatgccattaaccatgtgcccgagaagcggcctgtgcccattcgcaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgcaggaagagaagtattgaggaagccattcctgcagtttgcaagaccaggacggtcatttacgagatacctcggagccaggtggaccccacatcggccaacttcctgatctggcccccatgtgtggaggtgaagcgctgcactggctgttgtaacaccagcagcgtcaagtgccagccttcacgggtccaccaccgcagtgtcaaggtggccaaagtggagtatgtcaggaagaagccaaaattgaaagaggtccaggtgaggttagaggaacacctggagtgtgcatgtgcgacctccaacctgaacccagaccatcgggaggaggagacagatgtgaggtga

SEQ ID NO: 322 - DNA, 2268 bp, Artificial Sequence
  luciferase fusion protein
atgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacgggaaggcctagggagtcaggtaaaaaacggaaaagaaaaaggttaaaacccacctaa

SEQ ID NO: 323 - DNA, 2406 bp, Artificial Sequence
  luciferase fusion protein
atgttccaccaggtgagaagagtgatgaccatccttttccttactatggttatttcatacttcggttgcatgaaggcggcgcccatgaaagaagtaaacgtccacggacaaggcaacttggcctacccaggtgtgcggacccatgggactctggagagcgtgaatgggcccagggcaggttcgagaggtctgacgacgacatcactggctgacacttttgagcacgtcatcgaagagctgctggatgaggaccagaaggttcggcccaacgaagaaaaccataaggacgcggacttgtacacttcccgggtgatgctcagcagtcaagtgcctttggagcctcctctactctttctgctggaggaatacaaaaattacctggatgccgcaaacatgtctatgagggttcggcgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacggcgccactccgaccctgcccgccgtggggagctgagcgtgtgtgacagtattagcgagtgggtcacagcggcagataaaaagactgcagtggacatgtctggcgggacggtcacagtcctagagaaagtcccggtatccaaaggccaactgaagcagtatttctacgagaccaagtgtaatcccatgggttacaccaaggaaggctgcaggggcatagacaaaaggcactggaactcgcaatgccgaactacccaatcgtatgttcgggcccttactatggatagcaaaaagagaattggctggcgattcataaggatagacacttcctgtgtatgtacactgaccattaaaaggggaagatag

SEQ ID NO: 324 - DNA, 2376 bp, Artificial Sequence
  luciferase fusion protein
atgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatag

SEQ ID NO: 325 - DNA, 2358 bp, Artificial Sequence
  luciferase fusion protein
atgtccatgttgttctacactctgatcactgcgtttttgatcggcgtacaggcagaaccgtacacagatagcaatgtcccagaaggagactctgtccctgaagcccactggactaaacttcagcattcccttgacacagccctccgcagagcccgcagtgcccctactgcaccaatagctgcccgagtgacagggcagacccgcaacatcactgtagaccccagactgtttaagaaacggagactccactcaccccgtgtgctgttcagcacccagcctccacccacctcttcagacactctggatctagacttccaggcccatggtacaatccctttcaacaggactcaccggagcaagcgctactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcgctcatccacccacccagtcttccacatgggggagttctcagtgtgtgacagtgtcagtgtgtgggttggagataagaccacagccacagacatcaagggcaaggaggtgacagtgctggccgaggtgaacattaacaacagtgtattcagacagtacttttttgagaccaagtgccgagcctccaatcctgttgagagtgggtgccggggcatcgactccaaacactggaactcatactgcaccacgactcacaccttcgtcaaggcgttgacaacagatgagaagcaggctgcctggaggttcatccggatagacacagcctgtgtgtgtgtgctcagcaggaaggctacaagaagaggctga

SEQ ID NO: 326 - DNA, 2358 bp, Artificial Sequence
  luciferase fusion protein
atgtccatgttgttctacactctgatcacagcttttctgatcggcatacaggcggaaccacactcagagagcaatgtccctgcaggacacaccatcccccaagcccactggactaaacttcagcattcccttgacactgcccttcgcagagcccgcagcgccccggcagcggcgatagctgcacgcgtggcggggcagacccgcaacattactgtggaccccaggctgtttaaaaagcggcgactccgttcaccccgtgtgctgtttagcacccagcctccccgtgaagctgcagacactcaggatctggacttcgaggtcggtggtgctgcccccttcaacaggactcacaggagcaagcggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcggtcatcatcccatcccatcttccacaggggcgaattctcggtgtgtgacagtgtcagcgtgtgggttggggataagaccaccgccacagacatcaagggcaaggaggtgatggtgttgggagaggtgaacattaacaacagtgtattcaaacagtacttttttgagaccaagtgccgggacccaaatcccgttgacagcgggtgccggggcattgactcaaagcactggaactcatattgtaccacgactcacacctttgtcaaggcgctgaccatggatggcaagcaggctgcctggcggtttatccggatagatacggcctgtgtgtgtgtgctcagcaggaaggctgtgagaagagcctga

SEQ ID NO: 327 - DNA, 3459 bp, Artificial Sequence
  luciferase fusion protein
atgaagtgggtaacctttctcctcctcctcttcgtctccggctctgctttttccaggggtgtgtttcgccgatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgccgagaagcacacaagagtgagatcgcccatcggtataatgatttgggagaacaacatttcaaaggcctagtcctgattgccttttcccagtatctccagaaatgctcatacgatgagcatgccaaattagtgcaggaagtaacagactttgcaaagacgtgtgttgccgatgagtctgccgccaactgtgacaaatcccttcacactctttttggagataagttgtgtgccattccaaacctccgtgaaaactatggtgaactggctgactgctgtacaaaacaagagcccgaaagaaacgaatgtttcctgcaacacaaagatgacaaccccagcctgccaccatttgaaaggccagaggctgaggccatgtgcacctcctttaaggaaaacccaaccacctttatgggacactatttgcatgaagttgccagaagacatccttatttctatgccccagaacttctttactatgctgagcagtacaatgagattctgacccagtgttgtgcagaggctgacaaggaaagctgcctgaccccgaagcttgatggtgtgaaggagaaagcattggtctcatctgtccgtcagagaatgaagtgctccagtatgcagaagtttggagagagagcttttaaagcatgggcagtagctcgtctgagccagacattccccaatgctgactttgcagaaatcaccaaattggcaacagacctgaccaaagtcaacaaggagtgctgccatggtgacctgctggaatgcgcagatgacagggcggaacttgccaagtacatgtgtgaaaaccaggcgactatctccagcaaactgcagacttgctgcgataaaccactgttgaagaaagcccactgtcttagtgaggtggagcatgacaccatgcctgctgatctgcctgccattgctgctgattttgttgaggaccaggaagtgtgcaagaactatgctgaggccaaggatgtcttcctgggcacgttcttgtatgaatattcaagaagacaccctgattactctgtatccctgttgctgagacttgctaagaaatatgaagccactctggaaaagtgctgcgctgaagccaatcctcccgcatgctacggcacagtgcttgctgaatttcagcctcttgtagaagagcctaagaacttggtcaaaaccaactgtgatctttacgagaagcttggagaatatggattccaaaatgccattctagttcgctacacccagaaagcacctcaggtgtcaaccccaactctcgtggaggctgcaagaaacctaggaagagtgggcaccaagtgttgtacacttcctgaagatcagagactgccttgtgtggaagactatctgtctgcaatcctgaaccgtgtgtgtctgctgcatgagaagaccccagtgagtgagcatgttaccaagtgctgtagtggatccctggtggaaaggcggccatgcttctctgctctgacagttgatgaaacatatgtccccaaagagtttaaagctgagaccttcaccttccactctgatatctgcacacttccagagaaggagaagcagattaagaaacaaacggctcttgctgagctggtgaagcacaagcccaaggctacagcggagcaactgaagactgtcatggatgactttgcacagttcctggatacatgttgcaaggctgctgacaaggacacctgcttctcgactgagggtccaaaccttgtcactagatgcaaagacgccttagcctaa

SEQ ID NO: 328 - DNA, 3462 bp, Artificial Sequence
  luciferase fusion protein
atgaagtgggtaacctttatttcccttctttttctctttagctcggcttattccaggggtgtgtttcgtcgatactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaacgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataa

SEQ ID NO: 329 - DNA, 2043 bp, Artificial Sequence
  luciferase fusion protein
atgggcttcctgaagttctcccctttcctggttgtcagcatcttgctcctgtaccaggcatgcagcctccaggcagtgcctttgaggtcaatcttggaaagcagcccaggcatggccactctcagtgaagaagaagttcgcctgctggctgcactggtgcaggactatatgcagatgaaagccagggagctggagcaggaggaagagcaggaggctgagggctctagcttggacagccccagatctaagcggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcggtgtgggaatctgagtacctgcatgctgggcacgtacacacaagacctcaacaagtttcacaccttcccccaaacttcaattggggttgaagcacctggcaagaaaagggatgtggccaaggacttggagacaaaccaccaatcccattttggcaactaa

SEQ ID NO: 330 - DNA, 2058 bp, Artificial Sequence
  luciferase fusion protein
atgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtactgcgccactgttcattgccaggactgtccttacgaacctgatccaccaaacacagttccaacttcctgtgaagctaaagaaggagaatgtattgatagcagctgtggcacctgcacgagagacatactatcagatggactgtgtgaaaataaaccaggaaaaacatgttgccgaatgtgtcagtatgtaattgaatgcagagtagaggccgcaggatggtttagaacattctatggaaagagattccagttccaggaacctggtacatacgtgttgggtcaaggaaccaagggcggcgactggaaggtgtccatcaccctggagaacctggatggaaccaagggggctgtgctgaccaagacaagactggaagtggctggagacatcattgacatcgctcaagctactgagaatcccatcactgtaaacggtggagctgaccctatcatcgccaacccgtacaccatcggcgaggtcaccatcgctgttgttgagatgccaggcttcaacatcaccgtcattgagttcttcaaactgatcgtgatcgacatcctcggaggaagatctgtaagaatcgccccagacacagcaaacaaaggaatgatctctggcctctgtggagatcttaaaatgatggaagatacagacttcacttcagatccagaacaactcgctattcagcctaagatcaaccaggagtttgacggttgtccactctatggaaatcctgatgacgttgcatactgcaaaggtcttctggagccgtacaaggacagctgccgcaaccccatcaacttctactactacaccatctcctgcgccttcgcccgctgtatgggtggagacgagcgagcctcacacgtgctgcttgactacagggagacgtgcgctgctcccgaaactagaggaacctgcgttttgtctggacatactttctacgatacatttgacaaagcaagataccaattccagggtccctgcaaggagattcttatggccgccgactgtttctggaacacttgggatgtgaaggtttcacacaggaatgttgactcttacactgaagtagagaaagtacgaatcaggaaacaatcgactgtagtagaactcattgttgatggaaaacagattctggttggaggagaagccgtgtccgtcccgtacagctctcagaacacttccatctactggcaagatggtgacatactgactacagccatcctacctgaagctctggtggtcaagttcaacttcaagcaactgctcgtcgtacatattagagatccattcgatggtaagacttgcggtatttgcggtaactacaaccaggatttcagtgatgattcttttgatgctgaaggagcctgtgatctgacccccaacccaccgggatgcaccgaagaacagaaacctgaagctgaacgactctgcaatagtctcttcgccggtcaaagtgatcttgatcagaaatgtaacgtgtgccacaagcctgaccgtgtcgaacgatgcatgtacgagtattgcctgaggggacaacagggtttctgtgaccacgcatgggagttcaagaaagaatgctacataaagcatggagacaccctagaagtaccagatgaatgcaaaaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaa

SEQ ID NO: 331 - protein, 265 aa, Artificial Sequence
  Luciferase fusion protein
MMCISKLPAVLLILSVALNHLRATPVRSGSNPQMDKRKCNTATCATQRLANFLVRSSNNLGPVLPPTNVGSNTYGKRNAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRNAAGDPNRESLDFLLV

SEQ ID NO: 332 - protein, 261 aa, Artificial Sequence
  Luciferase fusion protein
MGILKLQVFLIVLSVALNHLKATPIESHQVEKRKCNTATCATQRLANFLVHSSNNFGAILSSTNVGSNTYGKRNAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRNAVEVLKREPLNYLPL

SEQ ID NO: 333 - protein, 280 aa, Artificial Sequence
  Luciferase fusion protein
MALWMRFLPLLALLFLWESHPTQAFVKQHLCGSHLVEALYLVCGERGFFYTPMSRREVEDPQVAQLELGGGPGAGDLQTLALEVAQQKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRGIVDQCCTSICSLYQLENYCN

SEQ ID NO: 334 - protein, 280 aa, Artificial Sequence
  Luciferase fusion protein
MALWMRLLPLLALLALWGPDPAAAFVNQHLCGSHLVEALYLVCGERGFFYTPKTRREAEDLQVGQVELGGGPGAGSLQPLALEGSLQKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRGIVEQCCTSICSLYQLENYCN

SEQ ID NO: 335 - protein, 355 aa, Artificial Sequence
  Luciferase fusion protein
MKTIYFVAGLLIMLVQGSWQHALQDTEENPRSFPASQTEAHEDPDEMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIAEELGRKRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRGRRHADGSFSDEMSTILDNLATRDFINWLIQTKITDKK

SEQ ID NO: 336 - protein, 355 aa, Artificial Sequence
  Luciferase fusion protein
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRKRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRGRRHADGSFSDEMNTILDNLAARDFINWLIQTKITDRK

SEQ ID NO: 337 - protein, 269 aa, Artificial Sequence
  Luciferase fusion protein
MVAVRRPWPVTVAMLLILLACLGALVDAYPAKPEAPGEDASPEELSRYYASLRHYLNLVTRQRYGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRRDVPAALFSKLLFTDDSDSENLPFRPEGLDQW

SEQ ID NO: 338 - protein, 268 aa, Artificial Sequence
  Luciferase fusion protein
MVFVRRPWPALTTVLLALLVCLGALVDAYPIKPEAPGEDASPEELNRYYASLRHYLNLVTRQRYGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRRDGPDTLLSKTFFPDGEDRPVRSRSEGPDLW

SEQ ID NO: 339 - protein, 268 aa, Artificial Sequence
  Luciferase fusion protein
MLGNKRMGLCGLTLALSLLVCLGILAEGYPSKPDNPGEDAPAEDMARYYSALRHYINLITRQRYGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRRSSPETLISDLLMKESTENAPRTRLEDPSMW

SEQ ID NO: 340 - protein, 268 aa, Artificial Sequence
  Luciferase fusion protein
MLGNKRLGLSGLTLALSLLVCLGALAEAYPSKPDNPGEDAPAEDMARYYSALRHYINLITRQRYGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRRSSPETLISDLLMRESTENVPRTRLEDPAMW

SEQ ID NO: 341 - protein, 271 aa, Artificial Sequence
  Luciferase fusion protein
MAVAYCCLSLFLVSTWVALLLQPLQGTWGAPLEPMYPGDYATPEQMAQYETQLRRYINTLTRPRYGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRRAEEENTGGLPGVQLSPCTSPPVGLIPCSAPWS

SEQ ID NO: 342 - protein, 266 aa, Artificial Sequence
  Luciferase fusion protein
MAAARLCLSLLLLSTCVALLLQPLLGAQGAPLEPVYPGDNATPEQMAQYAADLRRYINMLTRPRYGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRRHKEDTLAFSEWGSPHAAVPRELSPLDL

SEQ ID NO: 343 - protein, 288 aa, Artificial Sequence
  Luciferase fusion protein
MLSCRLQCALAALCIVLALGGVTGAPSDPRLRQFLQKSLAAATGKQELAKYFLAELRKKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRKLSEPNQTENDALEPEDLPQAAEQDEMRLELQRSANSNPAMAPRERKAGCKNFFWKTFTSC

SEQ ID NO: 344 - protein, 308 aa, Artificial Sequence
  Luciferase fusion protein
MTALFLMSMLFGLTCGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDYLVGFSV

SEQ ID NO: 345 - protein, 288 aa, Artificial Sequence
  Luciferase fusion protein
MLSCRLQCALAALSIVLALGCVTGAPSDPRLRQFLQKSLAAAAGKQELAKYFLAELRKKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRKLSEPNQTENDALEPEDLSQAAEQDEMRLELQRSANSNPAMAPRERKAGCKNFFWKTFTSC

SEQ ID NO: 346 - protein, 275 aa, Artificial Sequence
  Luciferase fusion protein
MLLWVLFVILILTSGSHCSLPPSPPFRMQRHVDAIFTTNYRKLLSQLYARKVIQDIMNKQGERIQEQRARLSRQEDSMWTEDKQMTLESIRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRLQGFPRMKPSADA

SEQ ID NO: 347 - protein, 279 aa, Artificial Sequence
  Luciferase fusion protein
MPLWVFFFVILTLSNSSHCSPPPPLTLRMRRYADAIFTNSYRKVLGQLSARKLLQDIMSRQQGESNQERGARARLGRQVDSMWAEQKQMELESILVALRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRLQKHRNSQG

SEQ ID NO: 348 - protein, 405 aa, Artificial Sequence
  Luciferase fusion protein
MPRFCYSRSGALLLALLLQTSIDVWSWCLESSQCQDLTTESNLLACIRACKLDLSLETPVFPGNGDEQPLTENPRKYVMGHFRWDRFGPRNSSSAGSAAQRRAEEEAVWGDGSPEPSPREGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRSYSMEHFRWGKPVGKKRRPVKVYPNVAENESAEAFPLEFKRELEGERPLGLEQVLESDAEKDDGPYRVEHFRWSNPPKDKRYGGFMTSEKSQTPLVTLFKNAIIKNAHKKGQ

SEQ ID NO: 349 - protein, 437 aa, Artificial Sequence
  Luciferase fusion protein
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 350 - protein, 295 aa, Artificial Sequence
  Luciferase fusion protein
MACPSLACCLLGLLALTSACYIQNCPLGGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRAVLDLDMRKCLPCGPGGKGRCFGPSICCADELGCFVGTAEALRCQEENYLPSPCQSGQKPCGSGGRCAATGICCSPDGCRTDPACDPESAFSER

SEQ ID NO: 351 - protein, 295 aa, Artificial Sequence
  Luciferase fusion protein
MAGPSLACCLLGLLALTSACYIQNCPLGGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRAAPDLDVRKCLPCGPGGKGRCFGPNICCAEELGCFVGTAEALRCQEENYLPSPCQSGQKACGSGGRCAVLGLCCSPDGCHADPACDAEATFSQR

SEQ ID NO: 352 - protein, 338 aa, Artificial Sequence
  Luciferase fusion protein
MLARMLNTTLSACFLSLLAFSSACYFQNCPRGGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRAISDMELRQCLPCGPGGKGRCFGPSICCADELGCFVGTAEALRCQEENYLPSPCQSGQKPCGSGGRCAAVGICCSDESCVAEPECHDGFFRLTRAREPSNATQLDGPARALLLRLVQLAGTRESVDSAKPRVY

SEQ ID NO: 353 - protein, 334 aa, Artificial Sequence
  Luciferase fusion protein
MPDTMLPACFLGLLAFSSACYFQNCPRGGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRAMSDLELRQCLPCGPGGKGRCFGPSICCADELGCFVGTAEALRCQEENYLPSPCQSGQKACGSGGRCAAFGVCCNDESCVTEPECREGFHRRARASDRSNATQLDGPAGALLLRLVQLAGAPEPFEPAQPDAY

SEQ ID NO: 354 - protein, 260 aa, Artificial Sequence
  Luciferase fusion protein
MILKLMAGILLLTVCLEGCSSQHWSYGLRPGGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRNTEHLVESFQEMGKEVDQMAEPQHFECTVHWPRSPLRDLRGALESLIEEEARQKKM

SEQ ID NO: 355 - protein, 262 aa, Artificial Sequence
  Luciferase fusion protein
MKPIQKLLAGLILLTWCVEGCSSQHWSYGLRPGGKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRDAENLIDSFQEIVKEVGQLAETQRFECTTHQPRSPLRDLKGALESLIEEETGQKKI

SEQ ID NO: 356 - protein, 308 aa, Artificial Sequence
  Luciferase fusion protein
MSAAVLLSVLFALACGQAASFCIPTEYTMYVDRRECAYCLTINTTICAGYCMTRDINGKLFLPKYALSQDVCTYRDFIYRTVEIPGCPHHVTPYFSFPVAISCKCGKCNTDNSDCIHEAVRTNYCTKPQSFYLKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDYLGGFSV

SEQ ID NO: 357 - protein, 357 aa, Artificial Sequence
  Luciferase fusion protein
MRLRLLVSAGMLLVALSSCLPCRALLSRGSVPRAPRAPQPLNFLQPEQPQQPQPVLIRMGEEYFLRLGNLNRSPAARLSPNSTPLTAGRGSRPSHDQAAANFFRVLLQQLQMPQRSLDSRAEPAERGAEDALGGHQGALERERRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRSEEPPISLDLTFHLLREVLEMARAEQLAQQAHSNRKLMEIIGK

SEQ ID NO: 358 - protein, 366 aa, Artificial Sequence
  Luciferase fusion protein
MRLPLLVSAGVLLVALLPCPPCRALLSRGPVPGARQAPQHPQPLDFFQPPPQSEQPQQPQARPVLLRMGEEYFLRLGNLNKSPAAPLSPASSLLAGGSGSRPSPEQATANFFRVLLQQLLLPRRSLDSPAALAERGARNALGGHQEAPERERRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRSEEPPISLDLTFHLLREVLEMARAEQLAQQAHSNRKLMEIIGK

SEQ ID NO: 359 - protein, 322 aa, Artificial Sequence
  Luciferase fusion protein
MGSFSITLGFFLVLAFWLPGHIGANPVYSAVSNTDLMDFKNLLDHLEEKMPVEDEVMPPQALSEQTEEAGAALSSLPEVPPWTGEVNPPLRDGSALGRSPWDPSDRSALLKSKLRALLAGPRSKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRSLRRSSCFGGRIDRIGAQSGLGCNSFRYRR

SEQ ID NO: 360 - protein, 321 aa, Artificial Sequence
  Luciferase fusion protein
MSSFSTTTVSFLLLLAFQLLGQTRANPMYNAVSNADLMDFKNLLDHLEEKMPLEDEVVPPQVLSEPNEEAGAALSPLPEVPPWTGEVSPAQRDGGALGRGPWDSSDRSALLKSKLRALLTAPRSKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRSLRRSSCFGGRMDRIGAQSGLGCNSFRY

SEQ ID NO: 361 - protein, 306 aa, Artificial Sequence
  Luciferase fusion protein
MDPQTAPSRALLLLLFLHLAFLGGRSHPLGSPGSASDLETSGLQEQRNHLQGKLSELQVEQTSLEPLQESPRPTGVWKSREVATEGIRGHRKMVLYTLRAPRSKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRSRSPKMVQGSGCFGRKMDRISSSSGLGCKVLRRH

SEQ ID NO: 362 - protein, 572 aa, Artificial Sequence
  Luciferase fusion protein
MDRRRMPLWALLLLWSPCTFSLPTRTATFERIPLKKMPSVREILEERGVDMTRLSAEWGVFTKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRPSLTNLTSPVVLTNYLNTQYYGEIGIGTPPQTFKVIFDTGSANLWVPSTKCSRLYLACGIHSLYESSDSSSYMENGSDFTIHYGSGRVKGFLSQDSVTVGGITVTQTFGEVTELPLIPFMLAKFDGVLGMGFPAQAVGGVTPVFDHILSQGVLKEEVFSVYYNRGSHLLGGEVVLGGSDPQHYQGNFHYVSISKTDSWQITMKGVSVGSSTLLCEEGCAVVVDTGSSFISAPTSSLKLIMQALGAKEKRIEEYVVNCSQVPTLPDISFDLGGRAYTLSSTDYVLQYPNRRDKLCTLALHAMDIPPPTGPVWVLGATFIRKFYTEFDRHNNRIGFALAR

SEQ ID NO: 363 - protein, 576 aa, Artificial Sequence
  Luciferase fusion protein
MDGWRRMPRWGLLLLLWGSCTFGLPTDTTTFKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRIFLKRMPSIRESLKERGVDMARLGPEWSQPMKRLTLGNTTSSVILTNYMDTQYYGEIGIGTPPQTFKVVFDTGSSNVWVPSSKCSRLYTACVYHKLFDASDSSSYKHNGTELTLRYSTGTVSGFLSQDIITVGGITVTQMFGEVTEMPALPFMLAEFDGVVGMGFIEQAIGRVTPIFDNIISQGVLKEDVFSFYYNRDSENSQSLGGQIVLGGSDPQHYEGNFHYINLIKTGVWQIQMKGVSVGSSTLLCEDGCLALVDTGASYISGSTSSIEKLMEALGAKKRLFDYVVKCNEGPTLPDISFHLGGKEYTLTSADYVFQESYSSKKLCTLAIHAMDIPPPTGPTWALGATFIRKFYTEFDRRNNRIGFALAR

SEQ ID NO: 364 - protein, 295 aa, Artificial Sequence
  Luciferase fusion protein
MARGSVILLGWLLLVVTLSATLGLGMPAKEKRGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRGWTLNSAGYLLGPHAIDNHRSFSDKHGLTGKRELQLEVEERRPGSVDVPLPESNIVRTIMEFLSFLHLKEAGALDSLPGIPLATSSEDLEKS

SEQ ID NO: 365 - protein, 294 aa, Artificial Sequence
  Luciferase fusion protein
MARGSALLLASLLLAAALSASAGLWSPAKEKRGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRGWTLNSAGYLLGPHAVGNHRSFSDKNGLTSKRELRPEDDMKPGSFDRSIPENNIMRTIIEFLSFLHLKEAGALDRLLDLPAAASSEDIERS

SEQ ID NO: 366 - protein, 301 aa, Artificial Sequence
  Luciferase fusion protein
MNFPSTKVPWAAVTLLLLLLLPPALLSLGVDAQPLPDCCRQKTCSCRLYELLHGAGNHAAGILTLGKRRPGPPGLQGRLQRLLQANGNHAAGILTMGRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDGRRAGAELEPHPCSGRGCPTVTTTALAPRGGSGV

SEQ ID NO: 367 - protein, 302 aa, Artificial Sequence
  Luciferase fusion protein
MNLPSTKVSWAAVTLLLLLLLLPPALLSSGAAAQPLPDCCRQKTCSCRLYELLHGAGNHAAGILTLGKRRSGPPGLQGRLQRLLQASGNHAAGILTMGRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDGRRAGAEPAPRPCLGRRCSAPAAASVAPGGQSGI

SEQ ID NO: 368 - protein, 288 aa, Artificial Sequence
  Luciferase fusion protein
MLSSGTICSLLLLSMLWMDMAMAGSSFLSPEHQKAQQRKESKKPPAKLQPRAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDPRALEGWLHPEDRGQAEETEEELEIRFNAPFDVGIKLSGAQYQQHGRALGKFLQDILWEEVKEAPADK

SEQ ID NO: 369 - protein, 287 aa, Artificial Sequence
  Luciferase fusion protein
MPSPGTVCSLLLLGMLWLDLAMAGSSFLSPEHQRVQRKESKKPPAKLQPRAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDPRALAGWLRPEDGGQAEGAEDELEVRFNAPFDVGIKLSGVQYQQHSQALGKFLQDILWEEAKEAPADK

SEQ ID NO: 370 - protein, 289 aa, Artificial Sequence
  Luciferase fusion protein
MKSGVCLCVVMAVLAAGALAQPVVPAEATDPVEQRAQEAPRRQLRAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRQLRAVLRTDGEPRARLGALLARYIQQVRKAPSGRMSVLKNLQSLDPSHRISDRDYMGWMDFGRRSAEDYEYPS

SEQ ID NO: 371 - protein, 289 aa, Artificial Sequence
  Luciferase fusion protein
MNSGVCLCVLMAVLAAGALTQPVPPADPAGSGLQRAEEAPRRQLRVKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRQLRVSQRTDGESRAHLGALLARYIQQARKAPSGRMSIVKNLQNLDPSHRISDRDYMGWMDFGRRSAEEYEYPS

SEQ ID NO: 372 - protein, 272 aa, Artificial Sequence
  Luciferase fusion protein
MPRLCVYMLVLVLALATFSEASWKPRSQLQDASSGPGTNEDLEQRQFNKLGSASHHRRQLGPQGPQHFIADLSKKQRPRMEEEEEAYGWMDFGRRSKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRSAEEDQ

SEQ ID NO: 373 - protein, 272 aa, Artificial Sequence
  Luciferase fusion protein
MQRLCVYVLIFALALAAFSEASWKPRSQQPDAPLGTGANRDLELPWLEQQGPASHHRRQLGPQGPPHLVADPSKKQGPWLEEEEEAYGWMDFGRRSKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRSAEDEN

SEQ ID NO: 374 - protein, 300 aa, Artificial Sequence
  Luciferase fusion protein
MKILVAVAVFFLVSTQLFAEEIDANDDLNYWSDWSDSDQIKEAMPEPFEHLLQRIARRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRPKPQQFFGLMGKRDADSSVEKQVALLKALYGHGQISHKRHKTDSFVGLMGKRALNSVAYERSAMQNYERRRK

SEQ ID NO: 375 - protein, 299 aa, Artificial Sequence
  Luciferase fusion protein
MKILVALAVFFLVSTQLFAEEIGANDDLNYWSDWYDSDQIKEELPEPFEHLLQRIARRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRPKPQQFFGLMGKRDADSSIEKQVALLKALYGHGQISHKRHKTDSFVGLMGKRALNSVAYERSAMQNYERRR

SEQ ID NO: 376 - protein, 438 aa, Artificial Sequence
  Luciferase fusion protein
MARFLRLCTWLLALGSCLLATVQAECSQDCAKCSYRLVRPGDINFLACTLECEGQLPSFKIWETCKDLLQVSRPEFPWDNIDMYKDSSKQDESHLLAKKYGGFMKRYGGFMKKMDELYPMEPEEEANGGEILAKRYGGFMKKDADEGDTLANSSDLLKELLGTGDNRAKDSHQQESTNNDEDMSKRYGGFMRSLKRSPQLEDEAKELQKRYGGFMRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRVGRPEWWMDYQKRYGGFLKRFAESLPSDEEGENYSKEVPEIEKRYGGFMRF

SEQ ID NO: 377 - protein, 437 aa, Artificial Sequence
  Luciferase fusion protein
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMKRYGGFMKKMDELYPMEPEEEANGSEILAKRYGGFMKKDAEEDDSLANSSDLLKELLETGDNRERSHHQDGSDNEEEVSKRYGGFMRGLKRSPQLEDEAKELQKRYGGFMRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRVGRPEWWMDYQKRYGGFLKRFAEALPSDEEGESYSKEVPEMEKRYGGFMRF

SEQ ID NO: 378 - protein, 418 aa, Artificial Sequence
  Luciferase fusion protein
MAWSRLMLAACLLVMPSNVMADCLSLCSLCAVRIQDGPRPINPLICSLECQDLVPPSEEWETCRGFSSFLTLTVSGLRGKDDLEDEVALEEGYSALAKLLEPVLKELEKSRLLTSVPEEKFRGLSSSFGNGKESELAGADRMNDEAAQAGTLHFNEEDLRKQAKRYGGFLRKYPKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRSSEMARDEDGGQDGDQVGHEDLYKRYGGFLRRIRPKLKWDNQKRYGGFLRRQFKVVTRSQENPNTYSEDLDV

SEQ ID NO: 379 - protein, 424 aa, Artificial Sequence
  Luciferase fusion protein
MAWQGLVLAACLLMFPSTTADCLSRCSLCAVKTQDGPKPINPLICSLQCQAALLPSEEWERCQSFLSFFTPSTLGLNDKEDLGSKSVGEGPYSELAKLSGSFLKELEKSKFLPSISTKENTLSKSLEEKLRGLSDGFREGAESELMRDAQLNDGAMETGTLYLAEEDPKEQVKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRYGGFLRKYPKRSSEVAGEGDGDSMGHEDLYKRYGGFLRRIRPKLKWDNQKRYGGFLRRQFKVVTRSQEDPNAYSGELFDA

SEQ ID NO: 380 - protein, 332 aa, Artificial Sequence
  Luciferase fusion protein
MGKISSLPTQLFKICLCDFLKIKIHIMSSSHLFYLALCLLTFTSSTTAGPETLCGAELVDALQFVCGPRGFYFNKPTGYGSSIRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDSSIRRAPQTGIVDECCFRSCDLRRLEMYCAPLKPTKAARSIRAQRHTDMPKTQKSPSLSTNKKTKLQRRRKGSTFEEHK

SEQ ID NO: 381 - protein, 330 aa, Artificial Sequence
  Luciferase fusion protein
MGKISSLPTQLFKCCFCDFLKVKMHTMSSSHLFYLALCLLTFTSSATAGPETLCGAELVDALQFVCGDRGFYFNKPTGYGSSSRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDSSRRAPQTGIVDECCFRSCDLRRLEMYCAPLKPAKSARSVRAQRHTDMPKTQKYQPPSTNKNTKSQRRKGSTFEERK

SEQ ID NO: 382 - protein, 362 aa, Artificial Sequence
  Luciferase fusion protein
MGGSVAGFQVPMGIPVGKSMLVLLISLAFALCCIAAYGPGETLCGGELVDTLQFVCSDRGFYFSRPSSRANRRSRGIVEECCFRSCDLALLETYCATPAKSERDKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDERDVSTSQAVLPDDFPRYPVGKFFQYDTWRQSAGRLRRGLPALLRARRGRMLAKELKEFREAKRHRPLIVLPPKDPAHGGASSEMSSNHQ

SEQ ID NO: 383 - protein, 351 aa, Artificial Sequence
  Luciferase fusion protein
MGIPMGKSMLVLLTFLAFASCCIAAYRPSETLCGGELVDTLQFVCGDRGFYFSRPASRVSRRSRGIVEECCFRSCDLALLETYCATPAKSERDKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 384 - protein, 285 aa, Artificial Sequence
  Luciferase fusion protein
MMSANTVAKVMIIMLAVCLLTQTDGKPVRKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRAVSEIQLMHNLGKHLASMERMQWLRRKLQDMHNFVSLGVQMAARDGSHQKPTKKEENVLVDGNPKSLGEGDKADVDVLVKSKSQ

SEQ ID NO: 385 - protein, 285 aa, Artificial Sequence
  Luciferase fusion protein
MIPAKDMAKVMIVMLAICFLTKSDGKSVKKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRSVSEIQLMHNLGKHLNSMERVEWLRKKLQDVHNFVALGAPLAPRDAGSQRPRKKEDNVLVESHEKSLGEADKADVNVLTKAKSQ

SEQ ID NO: 386 - protein, 345 aa, Artificial Sequence
  Luciferase fusion protein
MLRRLVQQWSVLVFLLSYSVPSRGRSVEGLGRRLKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRAVSEHQLLHDKGKSIQDLRRRFFLHHLIAEIHTAEIRATSEVSPNSKPAPNTKNHPVRFGSDDEGRYLTQETNKVETYKEQPLKTPGKKKKGKPGKRREQEKKKRRTRSAWPSTAASGLLEDPLPHTSRPSLEPSLRTH

SEQ ID NO: 387 - protein, 347 aa, Artificial Sequence
  Luciferase fusion protein
MQRRLVQQWSVAVFLLSYAVPSCGRSVEGLSRRLKRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRRH

SEQ ID NO: 388 - protein, 265 aa, Artificial Sequence
  Luciferase fusion protein
MRTIFLLTLLTLAALCLSDLTDAKPSGPESDKAFMSKQEGNKVVNRLRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRYLGASVPSPDPLEPTREQCELNPACDELSDQYGLKTAYKRIYGITI

SEQ ID NO: 389 - protein, 270 aa, Artificial Sequence
  Luciferase fusion protein
MRALTLLALLALAALCIAGQAGAKPSGAESSKGAAFVSKQEGSEVVKRPRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRYLYQWLGAPVPYPDPLEPRREVCELNPDCDELADHIGFQEAYRRFYGPV

SEQ ID NO: 390 - protein, 336 aa, Artificial Sequence
  Luciferase fusion protein
MLMPTYFLLPLLLLLGGPRTSLSHKFYNTGPVFSCLNTALSEVKKNKLEDVPLLSKKSFGHLPTQDPSGEEDDNQTHLQIKRTFSGAAGGNGAGSTRYRYQSQAQHKGKLYPDKPKSDRGTKKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRGTKFTLSLDVPTNIMNILFNIDKAKNLRAKAAANAQLMAQIGKKK

SEQ ID NO: 391 - protein, 331 aa, Artificial Sequence
  Luciferase fusion protein
MLMPVHFLLLLLLLLGGPRTGLPHKFYKAKPIFSCLNTALSEAEKGQWEDASLLSKRSFHYLRSRDASSGEEEEGKEKKTFPISGARGGARGTRYRYVSQAQPRGKPRQDTAKSPHRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDHRTKFTLSLDVPTNIMNLLFNIAKAKNLRAQAAANAHLMAQIGRKK

SEQ ID NO: 392 - protein, 284 aa, Artificial Sequence
  Luciferase fusion protein
MMTRWALVVFVVLMLDRILFVPGTPIPTFQLLPQNSLETTPSSVTSESSSGTTTGPSASWSNSKASPYLDTRVKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDTRVILSLDVPIGLLRILLEQARYKAARNQAATNAQILAHVGRR

SEQ ID NO: 393 - protein, 283 aa, Artificial Sequence
  Luciferase fusion protein
MTRCALLLLMVLMLGRVLVVPVTPIPTFQLRPQNSPQTTPRPAASESPSAAPTWPWAAQSHCSPTRHPGSRIKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDSRIVLSLDVPIGLLQILLEQARARAAREQATTNARILARVGHC

SEQ ID NO: 394 - protein, 292 aa, Artificial Sequence
  Luciferase fusion protein
MIQRGRATLLVALLLLAQLRPESSQWSPAAAAATGVQDPNLRWSPGVRNQGGGVRALLLLLAERFPRRAGSEPAGERQRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRDDPPLSIDLTFHLLRTLLELARTQSQRERAEQNRIIFDSVGK

SEQ ID NO: 395 - protein, 294 aa, Artificial Sequence
  Luciferase fusion protein
MRQAGRAALLAALLLLVQLCPGSSQRSPEAAGVQDPSLRWSPGARNQGGGARALLLLLAERFPRRAGPGRLGLGTAGERPRRKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDRRDNPSLSIDLTFHLLRTLLELARTQSQRERAEQNRIIFDSVGK

We claim:

1. A nucleic acid construct comprising a nucleic acid molecule comprising a sequence encoding a propeptide-bioluminescent fusion protein for expression in a cell wherein:
   the propeptide is a precursor to a mature peptide and the mature peptide is secreted or expressed at the cell surface,
   the propeptide-bioluminescent fusion protein comprises the bioluminescent protein and the propeptide wherein the bioluminescent protein is inserted into the propeptide,
   the bioluminescent protein comprises two cleavage sites, the first of which is positioned no more than four amino acids from the N-terminal end of the bioluminescent protein and the second of which is positioned no more than four amino acids from the C-terminal end of the bioluminescent protein, and
   when the propeptide-bioluminescent fusion protein is expressed by the cell, the bioluminescent protein is cleaved from the propeptide and the bioluminescent protein is secreted simultaneously with the secretion of the mature peptide, or
   when the bioluminescent-fusion protein is expressed by the cell, the bioluminescent protein is cleaved from the propeptide simultaneously upon expression of the mature peptide at the cell surface.

2. The nucleic acid construct of claim 1, wherein the propeptide is a prohormone, a preprohormone, a cytokine precursor or a neuropeptide precursor.

3. The nucleic acid construct of claim 1, wherein the bioluminescent protein comprises less than 200 amino acids.

4. The nucleic acid construct of claim 2, comprising any one of the nucleotide sequences of SEQ ID NO: 5-100.

5. The nucleic acid construct of claim 2, wherein the preprohormone is preproinsulin and the bioluminescent protein is within the C-peptide component of preproinsulin.

6. The nucleic acid construct of claim 2, wherein the preprohormone is preproamylin and the N-terminal end of the bioluminescent protein is inserted between the regions encoding the signal peptide and the mature amylin hormone or between the mature amylin hormone and the C-terminus of the molecule.

7. The nucleic acid construct of claim 2, wherein the preprohormone is preproglucagon and the bioluminescent protein is inserted between the regions encoding the GRPP and glucagon, glucagon and GLP-1, or GLP-1 and GLP-2.

8. The nucleic acid construct of claim 1, wherein the sequence encoding the first or second cleavage site or the first and second cleavage sites has a sequence selected from the group consisting of SEQ ID NOs: 101-138.

9. The nucleic acid construct of claim 2, further comprising a sequence encoding an additional cleavage site in the fusion protein at the N-terminal and C-terminal ends of the bioluminescent protein.

10. The nucleic acid construct of claim 1, further comprising at least 3 additional nucleotides flanking the DNA encoding at least one cleavage site.

11. The nucleic acid construct of claim 1, further comprising a promoter.

12. The nucleic acid construct of claim 1, wherein the bioluminescent protein is a luciferase.

13. The nucleic acid construct of claim 12, wherein the luciferase is a *Gaussia* luciferase.

14. The nucleic acid construct of claim 13, wherein the *Gaussia* luciferase lacks a native signal sequence.

15. The nucleic acid construct of claim 14, wherein the *Gaussia* luciferase comprises SEQ ID NO: 1.

16. The nucleic acid construct of claim 12, wherein the luciferase is a *Cypridina* luciferase.

17. The nucleic acid of construct of claim 16, wherein the *Cypridina* luciferase lacks a native signal sequence.

18. The nucleic acid construct of claim 17, wherein the *Cypridina* luciferase comprises SEQ ID NO: 3.

19. A cell comprising a nucleic acid construct of claim 1, wherein the cell is capable of expressing the encoded propeptide-bioluminescent fusion protein.

20. The cell of claim 1, wherein the cell is an endocrine cell, an immune cell, a neuron, a hepatocyte, a myocyte, a kidney cell, an adipocyte, an osteocyte or a cell line derived therefrom.

21. The cell of claim 19, wherein the cell is an endocrine cell, and the endocrine cell is a beta cell, an alpha cell, an L cell, a K cell, another endocrine cell, or a cell line derived from any of the foregoing endocrine cells.

22. The cell of claim 20, wherein the immune cell is a B cell, a T cell, a monocyte, a macrophage, a dendritic cell, a mast cell, a neutrophil or a cell line derived from any of the foregoing immune cells.

23. A cell comprising at least two nucleic acid constructs of claim 1, wherein the cell is capable of expressing the encoded fusion protein and wherein the bioluminescent proteins of the at least two nucleic acid constructs are different.

24. The cell of claim 23, wherein the first nucleic acid construct comprises a *Gaussia* luciferase and wherein the second nucleic acid construct comprises a *Cypridina* luciferase.

25. The cell of claim 19, wherein the cell further comprises a control nucleic acid construct encoding a control luciferase as an internal reference, wherein the cell is capable of expressing the control luciferase.

26. A nucleic acid expression vector comprising a nucleic acid construct of claim 1 operatively linked to a promoter and a selective marker operatively linked to a second promoter.

27. A kit comprising a cell of claim 19, and instructions for use.

28. The kit of claim 27, further comprising a control nucleic acid construct encoding a control luciferase as an internal reference.

29. The nucleic acid construct of claim 1,
comprising any one of the nucleotide sequences of SEQ ID NO: 139-330, or
encoding any one of the propeptide-bioluminescent fusion protein sequences of SEQ ID NO: 331-395, or
encoding a propeptide-bioluminescent fusion protein having at least 95% sequence identity to any one of the propeptide-bioluminescent fusion proteins encoded by any one of the nucleotide sequences of SEQ ID NO: 139-330, or
encoding a propeptide-bioluminescent fusion protein having at least 95% sequence identity to any one of the propeptide-bioluminescent fusion protein sequences of SEQ ID NO: 331-395,
wherein the propeptide-bioluminescent fusion protein having at least 95% sequence identity retains the ability to be cleaved to a bioluminescent protein and an active mature peptide.

30. The nucleic acid construct of claim 1 wherein the cell is of the same species as that from which the propeptide was derived.

31. A vector comprising the nucleic acid construct of claim 1.

* * * * *